(12) United States Patent
Fasan et al.

(10) Patent No.: US 9,273,342 B2
(45) Date of Patent: Mar. 1, 2016

(54) METHODS AND SYSTEMS FOR EVALUATING AND PREDICTING THE REACTIVITY OF MONOOXYGENASE ENZYMES

(75) Inventors: Rudi Fasan, Rochester, NY (US); Kaidong Zhang, Chilliwack (CA)

(73) Assignee: University of Rochester, Rochester, NY (US)

( * ) Notice: Subject to any disclaimer, the term of this patent is extended or adjusted under 35 U.S.C. 154(b) by 0 days.

(21) Appl. No.: 13/984,981

(22) PCT Filed: Feb. 10, 2012

(86) PCT No.: PCT/US2012/024723
§ 371 (c)(1),
(2), (4) Date: Oct. 22, 2013

(87) PCT Pub. No.: WO2012/109586
PCT Pub. Date: Aug. 16, 2012

(65) Prior Publication Data
US 2014/0038850 A1  Feb. 6, 2014

Related U.S. Application Data

(60) Provisional application No. 61/441,948, filed on Feb. 11, 2011.

(51) Int. Cl.
C40B 30/08 (2006.01)
C12Q 1/26 (2006.01)
C12N 15/10 (2006.01)

(52) U.S. Cl.
CPC ......... *C12Q 1/26* (2013.01); *C12N 15/102* (2013.01); *C12N 15/1093* (2013.01); *C40B 30/08* (2013.01); *G01N 2333/90241* (2013.01); *G01N 2333/90245* (2013.01)

(58) Field of Classification Search
None
See application file for complete search history.

(56) References Cited

U.S. PATENT DOCUMENTS

2006/0110767 A1   5/2006  Schuetz et al.
2007/0286856 A1  12/2007  Brown et al.
2008/0057577 A1*  3/2008  Arnold et al. ............ 435/348

FOREIGN PATENT DOCUMENTS

KR       100658184 B1   12/2006
WO    WO-2009125934 A2  10/2009
WO    WO-2010056053 A2   5/2010

OTHER PUBLICATIONS

Basile et al 2002 Analytical Chemistry 74: 4290-4293.*
Johannes et al "High-throughput Screening Methods Developed for Oxidoreductases" in: Ed. Jean-Louis Reymond, Enzyme Assays: High-throughput Screening, Genetic Selection and Fingerprinting (Weinheim, Wiley-CH Verlag GmbH & Co., 2006), pp. 77-93.*

(Continued)

*Primary Examiner* — Christian Boesen
(74) *Attorney, Agent, or Firm* — Harris Beach PLLC

(57) ABSTRACT

Methods and systems for evaluating and predicting the reactivity of natural and engineered monooxygenase enzymes are provided. Methods are provided for acquiring a functional profile (fingerprint) of monooxygenases that encode information regarding the active site configuration of such monooxygenases. Methods are also provided for carrying out analysis of a monooxygenase fingerprint, to formulate predictions regarding the reactivity properties (e.g., substrate reactivity, chemo-, regio, and stereoselectivity properties) of the fingerprinted monooxygenases.

20 Claims, 48 Drawing Sheets

(56) References Cited

OTHER PUBLICATIONS

Pazmiño et al 2010 Journal of Biotechnology 146: 9-24; epub Feb. 2, 2010.*
Fasan et al 2008 J. Mol. Biol 383: 1069-1080.*
Gould 1997 Environmental Health Perspectives 105: 977-979.*
Prasad et al 2002 Biochemistry 41: 14499-14508.*
Korean Intellectual Property Office International Search Report and Written Opinion of the International Searching Authority for International Application No. PCT/US2012/24723 mailed Dec. 3, 2012 (9 pages).

* cited by examiner

A
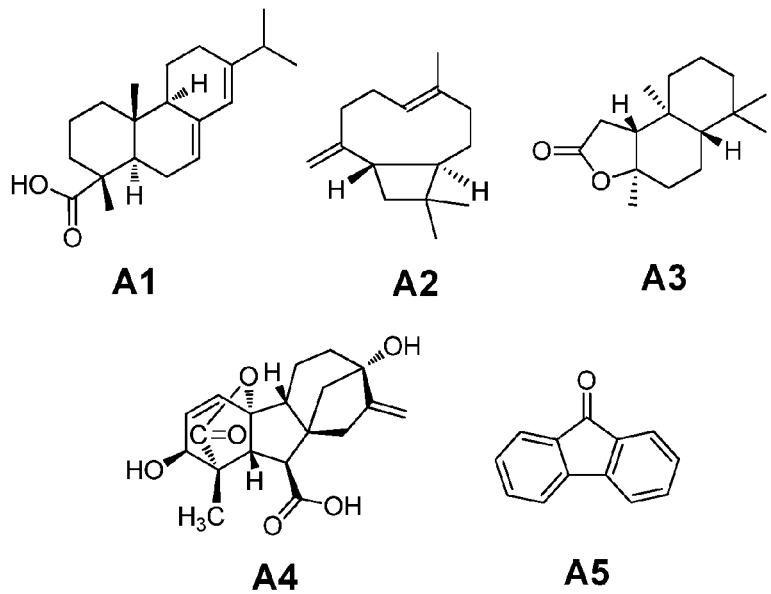
B
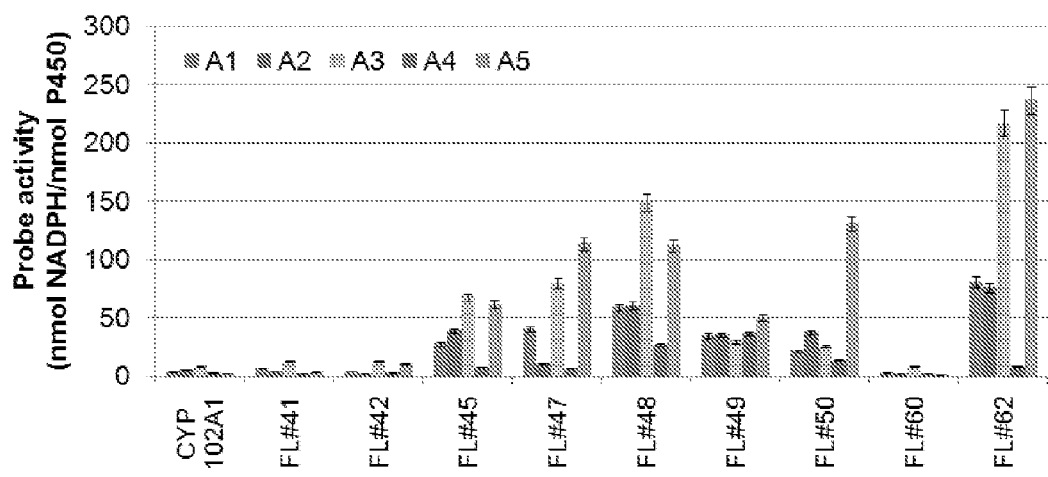
FIGS. 2 A-B

A
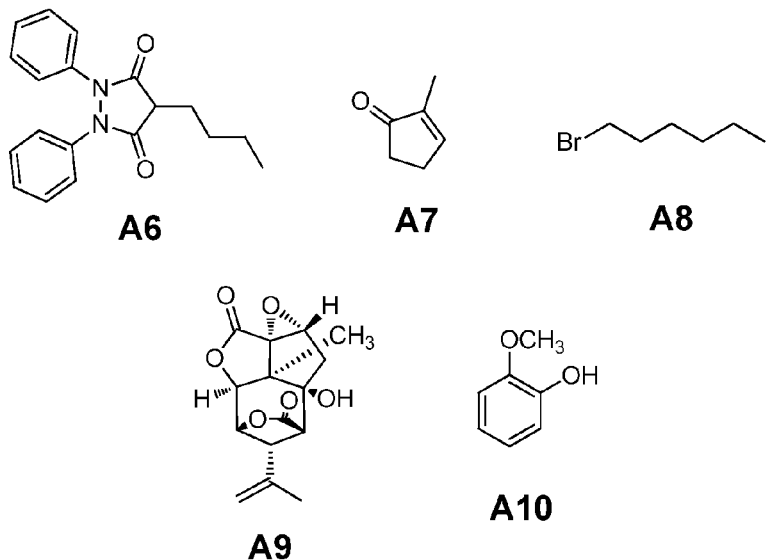
B
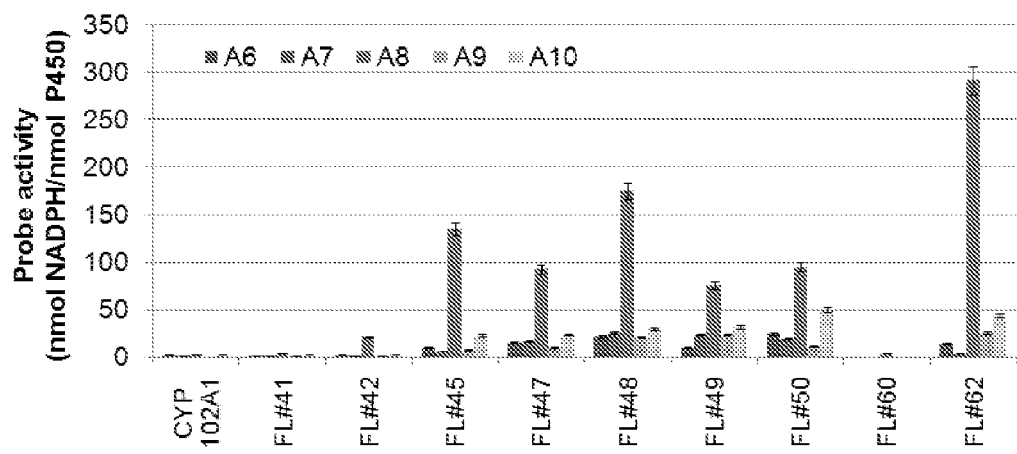
FIGS. 3A-B

A
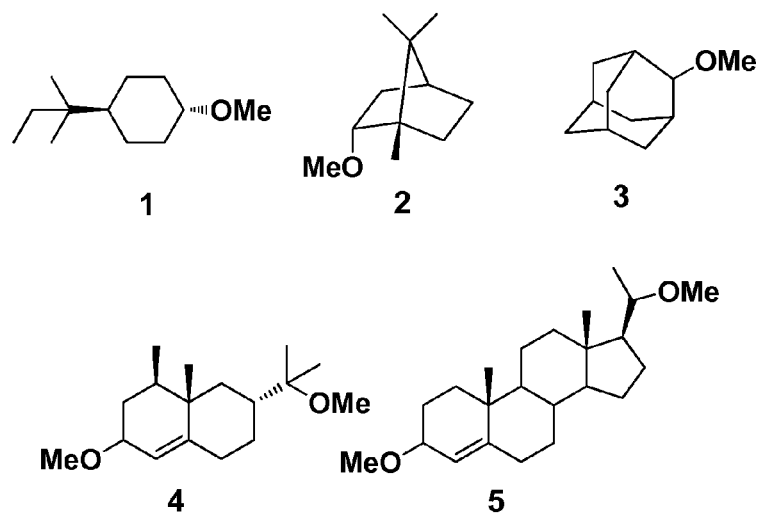
B
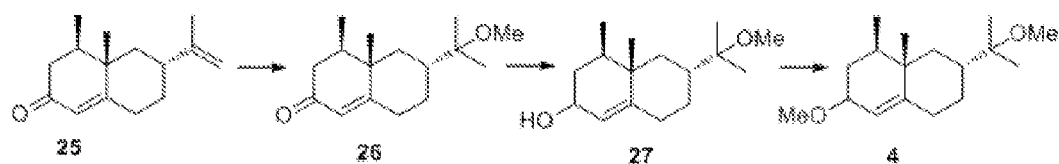
C
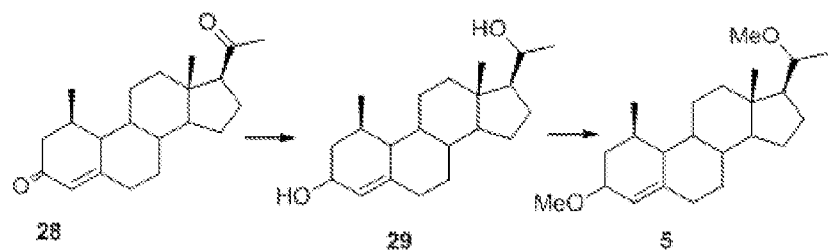
FIGS. 4A-C

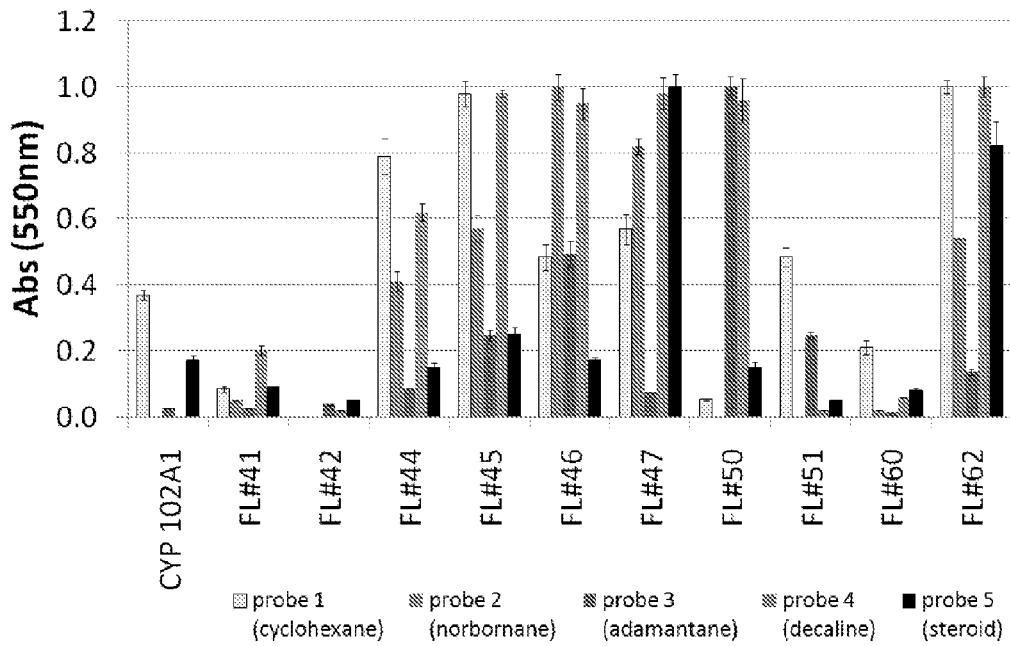
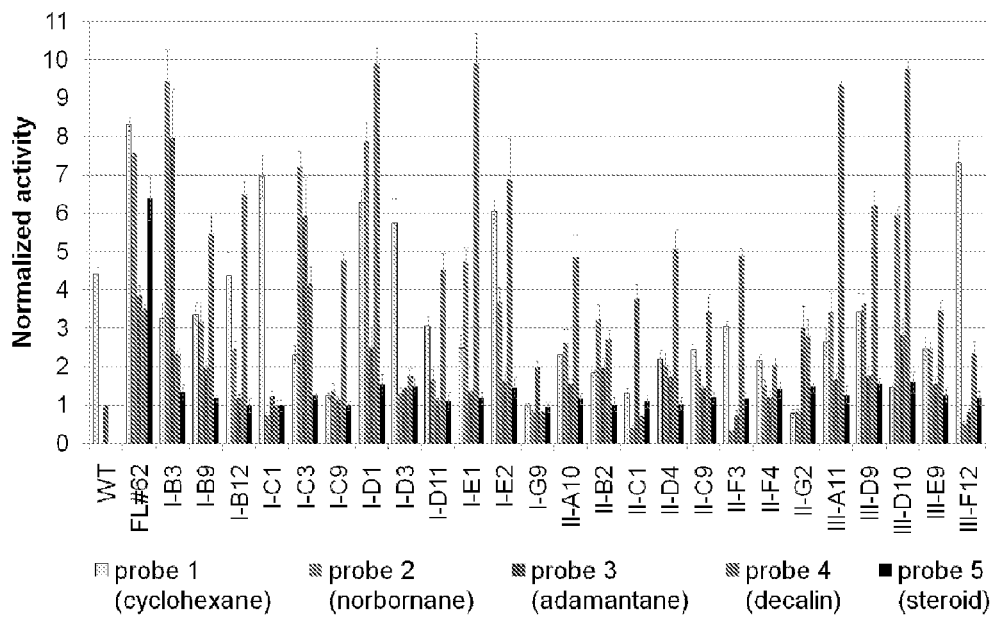
FIGS. 5A-B

B

Figure 7:
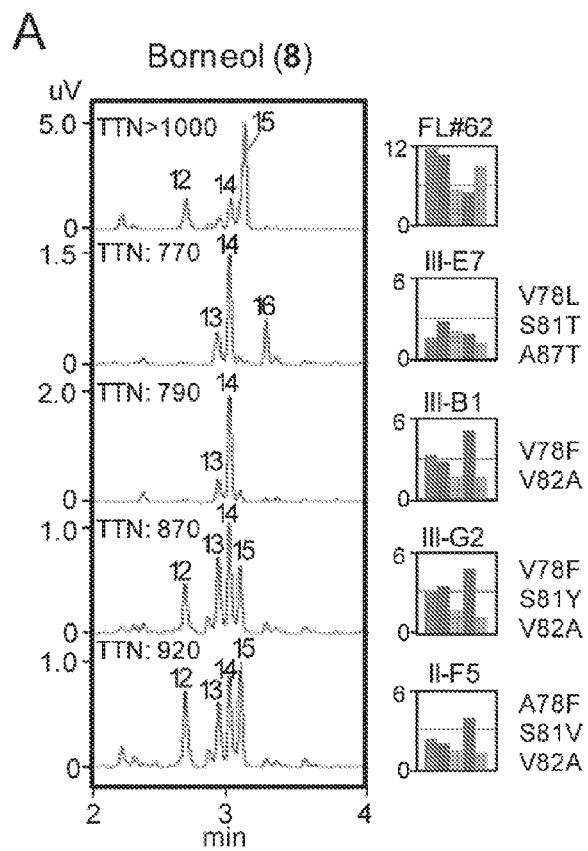

Product distribution of 8-active P450 variants described in FIG. 7A.

| P450 variant | Substrate | Oxidation products | | | | |
|---|---|---|---|---|---|---|
| | | 12 | 13 | 14 | 15 | 16 |
| FL#62 | 8 | 16% | | 11% | 73% | |
| III-E7 | 8 | | 15% | 69% | | 16% |
| III-B1 | 8 | | 11% | 89% | | |
| III-G2 | 8 | 20% | 16% | 49% | 15% | |
| II-F5 | 8 | 43% | 14% | 18% | 25% | |

FIGS. 7A-B

A

B

Figure 8:
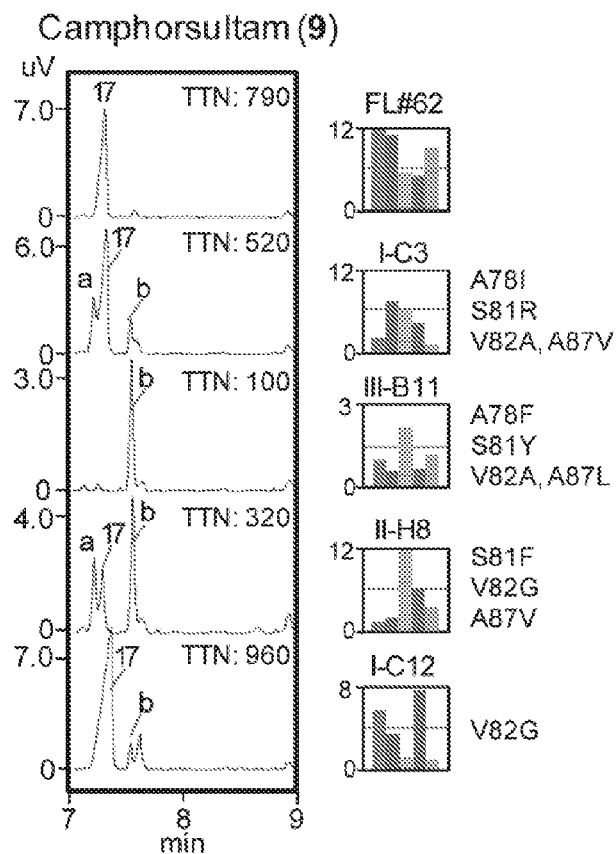

Product distribution of 9-active P450 variants described in FIG 8A.

| P450 variant | Substrate | Oxidation products | | |
|---|---|---|---|---|
| | | a* | 17 | b* |
| FL#62 | 9 | 7% | 93% | |
| I-C3 | 9 | 16% | 72% | 12% |
| III-B11 | 9 | | | 100% |
| II-H8 | 9 | 26% | 22% | 52% |
| I-C12 | 9 | 82% | 7% | 52% |

(*) Not isolated.

FIGS. 8A-B

FIGS. 9A-B

| Subst. | Enz. | Oxidation products | | | | | | | | |
|---|---|---|---|---|---|---|---|---|---|---|
| | | 22 | c* | | | | | | | |
| 7 | 5-G9 | 89% | 11% | | | | | | | |
| 7 | 5-C4 | 91% | 9% | | | | | | | |
| 7 | 5-C2 | 93% | 7% | | | | | | | |
| 7 | 5-C12 | 100% | | | | | | | | |
| | | | | 12 | 13 | 14 | 15 | 16 | | |
| 8 | 5-G9 | | | 12% | 10% | 69% | 9% | | | |
| 8 | 5-C4 | | | 12% | 10% | 76% | 2% | | | |
| 8 | 5-C2 | | | 12% | 10% | 76% | 2% | | | |
| 8 | 5-C12 | | | 15% | | 65% | | 20% | | |
| | | | | | | | | | 18 | 19 | 20 |
| 10 | 5-G9 | | | | | | | | | 15% | 85% |
| 10 | 5-C4 | | | | | | | | | 30% | 70% |
| 10 | 5-C2 | | | | | | | | | 31% | 69% |
| 10 | 5-C12 | | | | | | | | 26% | 8% | 56% |

(*) Not isolated.

FIG. 12

A
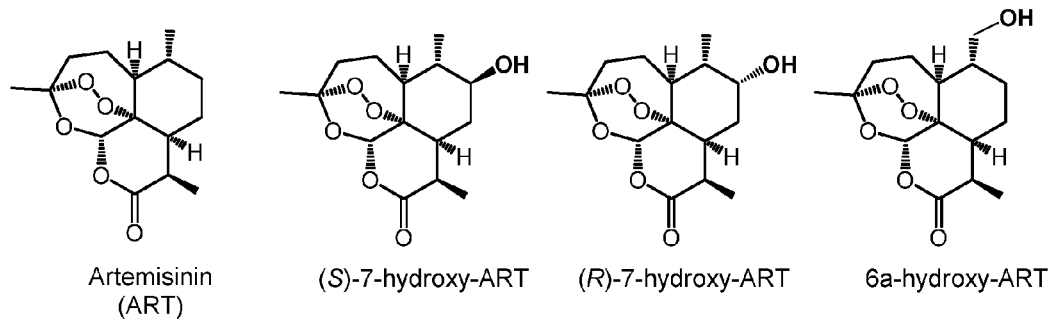
Artemisinin (ART)    (S)-7-hydroxy-ART    (R)-7-hydroxy-ART    6a-hydroxy-ART
B
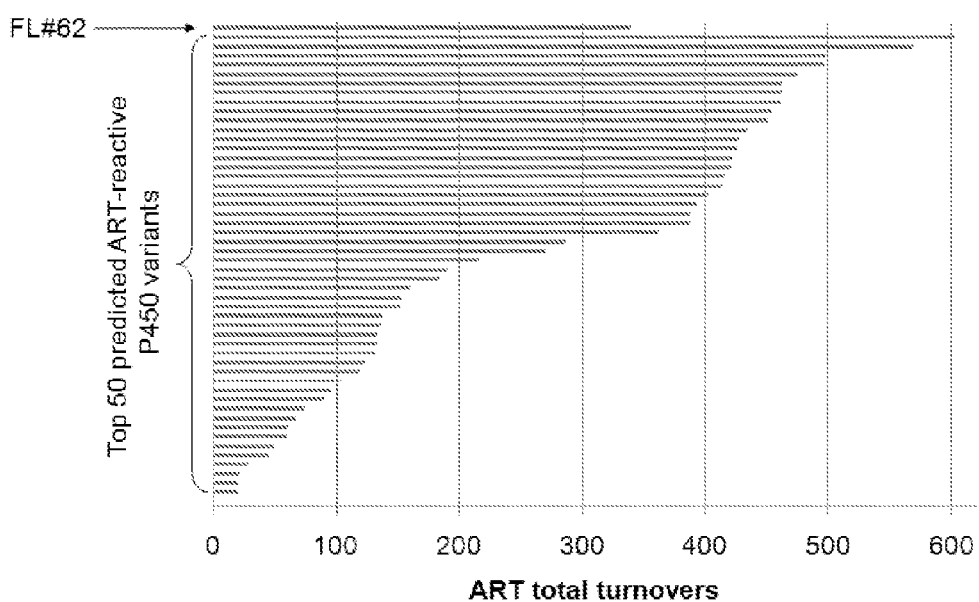
FIGS. 14A-B

CYP102A1 (from Bacillus megaterium)
SEQ ID NO:1
mTIKEMPQPKTFGELKNLPLLNTDKPVQALMKIADELGEIFKFEAPGRVTRYLSSQRLIKEACDESRFDKNL
SQALKFVRDFAGDGLFTSWTHEKNWKKAHNILLPSFSQQAMKGYHAMMVDIAVQLVQKWERLNADEHIE
VPEDMTRLTLDTIGLCGFNYRFNSFYRDQPHPFITSMVRALDEAMNKLQRANPDDPAYDENKRQFQEDIK
VMNDLVDKIIADRKASGEQSDDLLTHMLNGKDPETGEPLDDENIRYQIITFLIAGHETTSGLLSFALYFLVKN
PHVLQKAAEEAARVLVDPVPSYKQVKQLKYVGMVLNEALRLWPTAPAFSLYAKEDTVLGGEYPLEKGDE
LMVLIPQLHRDKTIWGDDVEEFRPERFENPSAIPQHAFKPFGNGQRACIGQQFALHEATLVLGMMLKHFD
FEDHTNYELDIKETLTLKPEGFVVKAKSKKIPLGGIPSPSTEQSAKKVRKKAENAHNTPLLVLYGSNMGTA
EGTARDLADIAMSKGFAPQVATLDSHAGNLPREGAVLIVTASYNGHPPDNAKQFVDWLDQASADEVKGV
RYSVFGCGDKNWATTYQKVPAFIDETLAAKGAENIADRGEADASDDFEGTYEEWREHMWSDVAAYFNL
DIENSEDNKSTLSLQFVDSAADMPLAKMHGAFSTNVVASKELQQPGSARSTRHLEIELPKEASYQEGDHL
GVIPRNYEGIVNRVTARFGLDASQQIRLEAEEEKLAHLPLAKTVSVEELLQYVELQDPVTRTQLRAMAAKT
VCPPHKVELEALLEKQAYKEQVLAKRLTMLELLEKYPACEMKFSEFIALLPSIRPRYYSISSSPRVDEKQAS
ITVSVVSGEAWSGYGEYKGIASNYLAELQEGDTITCFISTPQSEFTLPKDPETPLIMVGPGTGVAPFRGFV
QARKQLKEQGQSLGEAHLYFGCRSPHEDYLYQEELENAQSEGIITLHTAFSRMPNQPKTYVQHVMEQDG
KKLIELLDQGAHFYICGDGSQMAPAVEATLMKSYADVHQVSEADARLWLQQLEEKGRYAKDVWAG

FL#40 engineered SEQ ID NO:2
mTIKEMPQPKTFGELKNLPLLNTDKPVQALMKIADELGEIFKFEAPGRVTRYLSSQRLIKEACDESRFDKNL
SQALKFVRDFAGDGLATSWTHEKNWKKAHNILLPSFSQQAMKGYHAMMVDIAVQLVQKWERLNADEHIE
VPEDMTRLTLDTIGLCGFNYRFNSFYRDQPHPFITSMVRALDEAMNKLQRANPDDPAYDENKRQFQEDIK
VMNDLVDKIIADRKASGEQSDDLLTHMLNGKDPETGEPLDDENIRYQIITFLIAGHETTSGLLSFALYFLVKN
PHVLQKAAEEAARVLVDPVPSYKQVKQLKYVGMVLNEALRLWPTAPAFSLYAKEDTVLGGEYPLEKGDE
LMVLIPQLHRDKTIWGDDVEEFRPERFENPSAIPQHAFKPFGNGQRACIGQQFALHEATLVLGMMLKHFD
FEDHTNYELDIKETLTLKPEGFVVKAKSKKIPLGGIPSPSTEQSAKKVRKKAENAHNTPLLVLYGSNMGTA
EGTARDLADIAMSKGFAPQVATLDSHAGNLPREGAVLIVTASYNGHPPDNAKQFVDWLDQASADEVKGV
RYSVFGCGDKNWATTYQKVPAFIDETLAAKGAENIADRGEADASDDFEGTYEEWREHMWSDVAAYFNL
DIENSEDNKSTLSLQFVDSAADMPLAKMHGAFSTNVVASKELQQPGSARSTRHLEIELPKEASYQEGDHL
GVIPRNYEGIVNRVTARFGLDASQQIRLEAEEEKLAHLPLAKTVSVEELLQYVELQDPVTRTQLRAMAAKT
VCPPHKVELEALLEKQAYKEQVLAKRLTMLELLEKYPACEMKFSEFIALLPSIRPRYYSISSSPRVDEKQAS
ITVSVVSGEAWSGYGEYKGIASNYLAELQEGDTITCFISTPQSEFTLPKDPETPLIMVGPGTGVAPFRGFV
QARKQLKEQGQSLGEAHLYFGCRSPHEDYLYQEELENAQSEGIITLHTAFSRMPNQPKTYVQHVMEQDG
KKLIELLDQGAHFYICGDGSQMAPAVEATLMKSYADVHQVSEADARLWLQQLEEKGRYAKDVWAG

FL#41 engineered SEQ ID NO:3
mTIKEMPQPKTFGELKNLPLLNTDKPVQALMKIADELGEIFKFEAPGRVTRYLSSQRLIKEACDESRFDKNL
SQALKFVRDFAGDGLATSWTHEKNWKKAHNILLPSFSQQAMKGYHAMMVDIAVQLVQKWERLNADEHIE
VPEDMTRLTLDTIGLCGFNYRFNSFYRDQPHPFITSMVRALDEAMNKLQRANPDDPAYDENKRQFQEDIK
VMNDLVDKIIADRKASGEQSDDLLTHMLNGKDPETGEPLDDENIRYQIITFLIAGHETTSGLLSFALYFLVKN
PHVLQKAAEEAARVLVDPVPSYKQVKQLKYVGMVLNEALRLWPTAPAFSLYAKEDTVLGGEYPLEKGDE
LMVLIPQLHRDKTIWGDDVEEFRPERFENPSAIPQHAFKPFGNGQRACIGQQFALHEATLVLGMMLKHFD
FEDHTNYELDIKETLTLKPEGFVVKAKSKKIPLGGIPSPSTEQSAKKVRKKAENAHNTPLLVLYGSNMGTA
EGTARDLADIAMSKGFAPQVATLDSHAGNLPREGAVLIVTASYNGHPPDNAKQFVDWLDQASADEVKGV
RYSVFGCGDKNWATTYQKVPAFIDETLAAKGAENIADRGEADASDDFEGTYEEWREHMWSDVAAYFNL
DIENSEDNKSTLSLQFVDSAADMPLAKMHGAFSTNVVASKELQQPGSARSTRHLEIELPKEASYQEGDHL
GVIPRNYEGIVNRVTARFGLDASQQIRLEAEEEKLAHLPLAKTVSVEELLQYVELQDPVTRTQLRAMAAKT
VCPPHKVELEALLEKQAYKEQVLAKRLTMLELLEKYPACEMKFSEFIALLPSIRPRYYSISSSPRVDEKQAS
ITVSVVSGEAWSGYGEYKGIASNYLAELQEGDTITCFISTPQSEFTLPKDPETPLIMVGPGTGVAPFRGFV
QARKQLKEQGQSLGEAHLYFGCRSPHEDYLYQEELENAQSEGIITLHTAFSRMPNQPKTYVQHVMEQDG
KKLIELLDQGAHFYICGDGSQMAPAVEATLMKSYADVHQVSEADARLWLQQLEEKGRYAKDVWAG

FIG. 17-1

FL#42 engineered    SEQ ID NO:4
mTIKEMPQPKTFGELKNLPLLNTDKPVQALMKIADELGEIFKFEAPGRVTRYLSSQRLIKEACDESRFDKNL
SQALKFVRDFAGDGLFTSWTHEKNWKKAHNILLPSFSQQAMKGYHAMMVDIAVQLVQKWERLNADEHIE
VPEDMTRLTLDTIGLCGFNYRFNSFYRDQPHPFITSMVRALDEAMNKLQRANPDDPAYDENKRQFQEDIK
VMNDLVDKIIADRKASGEQSDDLLTHMLNGKDPETGEPLDDENIRYQIITFLIAGHETTSGLLSFALYFLVKN
PHVLQKAAEEAARVLVDPVPSYKQVKQLKYVGMVLNEALRLWPTVPAFSLYAKEDTVLGGEYPLEKGDE
LMVLIPQLHRDKTIWGDDVEEFRPERFENPSAIPQHAFKPFGNGQRACIGQQFALHEATLVLGMMLKHFD
FEDHTNYELDIKETLTLKPEGFVVKAKSKKIPLGGIPSPSTEQSAKKVRKKAENAHNTPLLVLYGSNMGTA
EGTARDLADIAMSKGFAPQVATLDSHAGNLPREGAVLIVTASYNGHPPDNAKQFVDWLDQASADEVKGV
RYSVFGCGDKNWATTYQKVPAFIDETLAAKGAENIADRGEADASDDFEGTYEEWREHMWSDVAAYFNL
DIENSEDNKSTLSLQFVDSAADMPLAKMHGAFSTNVVASKELQQPGSARSTRHLEIELPKEASYQEGDHL
GVIPRNYEGIVNRVTARFGLDASQQIRLEAEEEKLAHLPLAKTVSVEELLQYVELQDPVTRTQLRAMAAKT
VCPPHKVELEALLEKQAYKEQVLAKRLTMLELLEKYPACEMKFSEFIALLPSIRPRYYSISSSPRVDEKQAS
ITVSVVSGEAWSGYGEYKGIASNYLAELQEGDTITCFISTPQSEFTLPKDPETPLIMVGPGTGVAPFRGFV
QARKQLKEQGQSLGEAHLYFGCRSPHEDYLYQEELENAQSEGIITLHTAFSRMPNQPKTYVQHVMEQDG
KKLIELLDQGAHFYICGDGSQMAPAVEATLMKSYADVHQVSEADARLWLQQLEEKGRYAKDVWAG

FL#44 engineered    SEQ ID NO:5
mTIKEMPQPKTFGELKNLPLLNTDKPVQALMKIADELGEIFKFEAPGRVTRYLSSQRLIKEACDESRFDKNL
SQALKFARDFAGDGLFTSWTHEKNWKKAHNILLPSFSQQAMKGYHAMMVDIAVQLVQKWERLNADEYIE
VPEDMTRLTLDTIGLCGFNYRFNSFYRDQPHPFIISMIRALDEVMNKLQRANPDDPAYDENKRQFQEDIKV
MNDLVDKIIADRKASGEQSDDLLTQMLNGKDPETGEPLDDGNISYQIITFLIAGHETTSGLLSFALYFLVKNP
HVLQKVAEEATRVLVDPVPSYKQVKQLKYVGMVLNEALRLWPTAPAFSLYAKEDTVLGGEYPLEKGDEV
MVLIPQLHRDKTIWGDDVEEFRPERFENPSAIPQHAFKPFGNGQRACIGQQFALHEATLVLGMMLKHFDF
EDHTNYELDIKETLTLKPEGFVVKAKSKKIPLGGIPSPSTEQSAKKVRKKAENAHNTPLLVLYGSNMGTAE
GTARDLADIAMSKGFAPQVATLDSHAGNLPREGAVLIVTASYNGHPPDNAKQFVDWLDQASADEVKGVR
YSVFGCGDKNWATTYQKVPAFIDETLAAKGAENIADRGEADASDDFEGTYEEWREHMWSDVAAYFNLDI
ENSEDNKSTLSLQFVDSAADMPLAKMHGAFSTNVVASKELQQPGSARSTRHLEIELPKEASYQEGDHLG
VIPRNYEGIVNRVTARFGLDASQQIRLEAEEEKLAHLPLAKTVSVEELLQYVELQDPVTRTQLRAMAAKTV
CPPHKVELEALLEKQAYKEQVLAKRLTMLELLEKYPACEMKFSEFIALLPSIRPRYYSISSSPRVDEKQASIT
VSVVSGEAWSGYGEYKGIASNYLAELQEGDTITCFISTPQSEFTLPKDPETPLIMVGPGTGVAPFRGFVQA
RKQLKEQGQSLGEAHLYFGCRSPHEDYLYQEELENAQSEGIITLHTAFSRMPNQPKTYVQHVMEQDGKK
LIELLDQGAHFYICGDGSQMAPAVEATLMKSYADVHQVSEADARLWLQQLEEKGRYAKDVWAG

FL#45 engineered    SEQ ID NO:6
mTIKEMPQPKTFGELKNLPLLNTDKPVQALMKIADELGEIFKFEAPGRVTRYLSSQRLIKEACDESRFDKNL
SQALKAVRDFAGDGLFTSWTHEKNWKKAHNILLPSFSQQAMKGYHAMMVDIAVQLVQKWERLNADEHIE
VPEDMTRLTLDTIGLCGFNYRFNSFYRDQPHPFIISMVRALDEVMNKLQRANPDDPAYDENKRQCQEDIK
VMNDLVDKIIADRKARGEQSDDLLTQMLNGKDPETGEPLDDGNISYQIITFLIAGHETTSGLLSFALYFLVK
NPHVLQKVAEEAARVLVDPVPSYKQVKQLKYVGMVLNEALRLWPTAPAFSLYAKEDTVLGGEYPLEKGD
EVMVLIPQLHRDKTIWGDDVEEFRPERFENPSAIPQHAFKPFGNGQRACIGQQFALHEATLVLGMMLKHF
DFEDHTNYELDIKETLTLKPEGFVVKAKSKKIPLGGIPSPSTEQSAKKVRKKAENAHNTPLLVLYGSNMGT
AEGTARDLADIAMSKGFAPQVATLDSHAGNLPREGAVLIVTASYNGHPPDNAKQFVDWLDQASADEVKG
VRYSVFGCGDKNWATTYQKVPAFIDETLAAKGAENIADRGEADASDDFEGTYEEWREHMWSDVAAYFN
LDIENSEDNKSTLSLQFVDSAADMPLAKMHGAFSTNVVASKELQQPGSARSTRHLEIELPKEASYQEGDH
LGVIPRNYEGIVNRVTARFGLDASQQIRLEAEEEKLAHLPLAKTVSVEELLQYVELQDPVTRTQLRAMAAK
TVCPPHKVELEALLEKQAYKEQVLAKRLTMLELLEKYPACEMKFSEFIALLPSIRPRYYSISSSPRVDEKQA
SITVSVVSGEAWSGYGEYKGIASNYLAELQEGDTITCFISTPQSEFTLPKDPETPLIMVGPGTGVAPFRGF
VQARKQLKEQGQSLGEAHLYFGCRSPHEDYLYQEELENAQSEGIITLHTAFSRMPNQPKTYVQHVMEQD
GKKLIELLDQGAHFYICGDGSQMAPAVEATLMKSYADVHQVSEADARLWLQQLEEKGRYAKDVWAG

FIG. 17-2

FL#46 engineered    SEQ ID NO:7
mTIKEMPQPKTFGELKNLPLLNTDKPVQALMKIADELGEIFKFEAPGCVTRYLSSQRLIKEACDESRFDKNL
SQALKAVRDFAGDGLITSWTHEINWKKAHNILLPSFSQQAMKGYHAMMVDIAVQLVQKWERLNADEHIEV
SEDMTRLTLDTIGLCGFNYRFNSFYRDQPHPFIISMVRALDEVMNKLQRANPDDPAYDENKRQCQEDIKV
MNDLVDKIIADRKARGEQSDDLLTQMLNGKDPETGEPLDDGNISYQIITFLIAGHETTSGLLSFALYFLVKN
PHVLQKVAEEAARVLVDPVPSYKQVKQLKYVGMVLNEALRLWPTAPAFSLYAKEDTVLGGEYPLEKGDE
VMVLIPQLHRDKTIWGDDVEEFRPERFENPSAIPQHAFKPFGNGQRACIGQQFALHEATLVLGMMLKHFD
FEDHTNYELDIKETLTLKPEGFVVKAKSKKIPLGGIPSPSTEQSAKKVRKKAENAHNTPLLVLYGSNMGTA
EGTARDLADIAMSKGFAPQVATLDSHAGNLPREGAVLIVTASYNGHPPDNAKQFVDWLDQASADEVKGV
RYSVFGCGDKNWATTYQKVPAFIDETLAAKGAENIADRGEADASDDFEGTYEEWREHMWSDVAAYFNL
DIENSEDNKSTLSLQFVDSAADMPLAKMHGAFSTNVVASKELQQPGSARSTRHLEIELPKEASYQEGDHL
GVIPRNYEGIVNRVTARFGLDASQQIRLEAEEEKLAHLPLAKTVSVEELLQYVELQDPVTRTQLRAMAAKT
VCPPHKVELEALLEKQAYKEQVLAKRLTMLELLEKYPACEMKFSEFIALLPSIRPRYYSISSSPRVDEKQAS
ITVSVVSGEAWSGYGEYKGIASNYLAELQEGDTITCFISTPQSEFTLPKDPETPLIMVGPGTGVAPFRGFV
QARKQLKEQGQSLGEAHLYFGCRSPHEDYLYQEELENAQSEGIITLHTAFSRMPNQPKTYVQHVMEQDG
KKLIELLDQGAHFYICGDGSQMAPAVEATLMKSYADVHQVSEADARLWLQQLEEKGRYAKDVWAG

FL#47 engineered    SEQ ID NO:8
mTIKEMPQPKTFGELKNLPLLNTDKPVQALMKIADELGEIFKFEAPGCVTRYLSSQRLIKEACDESRFDKNL
SQALKAVRDFAGDGLATSWTHEINWKKAHNILLPSFSQQAMKGYHAMMVDIAVQLVQKWERLNADEHIE
VSEDMTRLTLDTIGLCGFNYRFNSFYRDQPHPFIISMVRALDEVMNKLQRANPDDPAYDENKRQCQEDIK
VMNDLVDKIIADRKARGEQSDDLLTQMLNGKDPETGEPLDDGNISYQIITFLIAGHETTSGLLSFALYFLVK
NPHVLQKVAEEAARVLVDPVPSYKQVKQLKYVGMVLNEALRLWPTAPAFSLYAKEDTVLGGEYPLEKGD
EVMVLIPQLHRDKTIWGDDVEEFRPERFENPSAIPQHAFKPFGNGQRACIGQQFALHEATLVLGMMLKHF
DFEDHTNYELDIKETLTLKPEGFVVKAKSKKIPLGGIPSPSTEQSAKKVRKKAENAHNTPLLVLYGSNMGT
AEGTARDLADIAMSKGFAPQVATLDSHAGNLPREGAVLIVTASYNGHPPDNAKQFVDWLDQASADEVKG
VRYSVFGCGDKNWATTYQKVPAFIDETLAAKGAENIADRGEADASDDFEGTYEEWREHMWSDVAAYFN
LDIENSEDNKSTLSLQFVDSAADMPLAKMHGAFSTNVVASKELQQPGSARSTRHLEIELPKEASYQEGDH
LGVIPRNYEGIVNRVTARFGLDASQQIRLEAEEEKLAHLPLAKTVSVEELLQYVELQDPVTRTQLRAMAAK
TVCPPHKVELEALLEKQAYKEQVLAKRLTMLELLEKYPACEMKFSEFIALLPSIRPRYYSISSSPRVDEKQA
SITVSVVSGEAWSGYGEYKGIASNYLAELQEGDTITCFISTPQSEFTLPKDPETPLIMVGPGTGVAPFRGF
VQARKQLKEQGQSLGEAHLYFGCRSPHEDYLYQEELENAQSEGIITLHTAFSRMPNQPKTYVQHVMEQD
GKKLIELLDQGAHFYICGDGSQMAPAVEATLMKSYADVHQVSEADARLWLQQLEEKGRYAKDVWAG

FL#48 engineered    SEQ ID NO:9
mTIKEMPQPKTFGELKNLPLLNTDKPVQALMKIADELGEIFKFEAPGCVTRYLSSQRLIKEACDESRFDKNL
SQALKAVRDFLGDGLFTSWTHEINWKKAHNILLPSFSQQAMKGYHAMMVDIAVQLVQKWERLNADEHIE
VSEDMTRLTLDTIGLCGFNYRFNSFYRDQPHPFIISMVRALDEVMNKLQRANPDDPAYDENKRQCQEDIK
VMNDLVDKIIADRKARGEQSDDLLTQMLNGKDPETGEPLDDGNISYQIITFLIAGHETTSGLLSFALYFLVK
NPHVLQKVAEEAARVLVDPVPSYKQVKQLKYVGMVLNEALRLWPTAPAFSLYAKEDTVLGGEYPLEKGD
EVMVLIPQLHRDKTIWGDDVEEFRPERFENPSAIPQHAFKPFGNGQRACIGQQFALHEATLVLGMMLKHF
DFEDHTNYELDIKETLTLKPEGFVVKAKSKKIPLGGIPSPSTEQSAKKVRKKAENAHNTPLLVLYGSNMGT
AEGTARDLADIAMSKGFAPQVATLDSHAGNLPREGAVLIVTASYNGHPPDNAKQFVDWLDQASADEVKG
VRYSVFGCGDKNWATTYQKVPAFIDETLAAKGAENIADRGEADASDDFEGTYEEWREHMWSDVAAYFN
LDIENSEDNKSTLSLQFVDSAADMPLAKMHGAFSTNVVASKELQQPGSARSTRHLEIELPKEASYQEGDH
LGVIPRNYEGIVNRVTARFGLDASQQIRLEAEEEKLAHLPLAKTVSVEELLQYVELQDPVTRTQLRAMAAK
TVCPPHKVELEALLEKQAYKEQVLAKRLTMLELLEKYPACEMKFSEFIALLPSIRPRYYSISSSPRVDEKQA
SITVSVVSGEAWSGYGEYKGIASNYLAELQEGDTITCFISTPQSEFTLPKDPETPLIMVGPGTGVAPFRGF
VQARKQLKEQGQSLGEAHLYFGCRSPHEDYLYQEELENAQSEGIITLHTAFSRMPNQPKTYVQHVMEQD
GKKLIELLDQGAHFYICGDGSQMAPAVEATLMKSYADVHQVSEADARLWLQQLEEKGRYAKDVWAG

FIG. 17-3

FL#49 engineered    SEQ ID NO:10
mTIKEMPQPKTFGELKNLPLLNTDKPVQALMKIADELGEIFKFEAPGCVTRYLSSQRLIKEACDESRFDKNL
SQALKAVRDFLGDGLFTSWTHEINWKKAHNILLPSFSQQAMKGYHAMMVDIAVQLVQKWERLNADEHIE
VSEDMTRLTLDTIGLCGFNYRFNSFYRDQPHPFIISMVRALDEVMNKLQRANPDDPAYDENKRQCQEDIK
VMNDLVDKIIADRKARGEQSDDLLTQMLNGKDPETGEPLDDGNISYQIITFLIAGHETTSGLLSFALYFLVK
NPHVLQKVAEEAARVLVDPVPSYKQVKQLKYVGMVLNEALRLWPTVPAFSLYAKEDTVLGGEYPLEKGD
EVMVLIPQLHRDKTIWGDDVEEFRPERFENPSAIPQHAFKPFGNGQRACIGQQFALHEATLVLGMMLKHF
DFEDHTNYELDIKETLTLKPEGFVVKAKSKKIPLGGIPSPSTEQSAKKVRKKAENAHNTPLLVLYGSNMGT
AEGTARDLADIAMSKGFAPQVATLDSHAGNLPREGAVLIVTASYNGHPPDNAKQFVDWLDQASADEVKG
VRYSVFGCGDKNWATTYQKVPAFIDETLAAKGAENIADRGEADASDDFEGTYEEWREHMWSDVAAYFN
LDIENSEDNKSTLSLQFVDSAADMPLAKMHGAFSTNVVASKELQQPGSARSTRHLEIELPKEASYQEGDH
LGVIPRNYEGIVNRVTARFGLDASQQIRLEAEEEKLAHLPLAKTVSVEELLQYVELQDPVTRTQLRAMAAK
TVCPPHKVELEALLEKQAYKEQVLAKRLTMLELLEKYPACEMKFSEFIALLPSIRPRYYSISSSPRVDEKQA
SITVSVVSGEAWSGYGEYKGIASNYLAELQEGDTITCFISTPQSEFTLPKDPETPLIMVGPGTGVAPFRGF
VQARKQLKEQGQSLGEAHLYFGCRSPHEDYLYQEELENAQSEGIITLHTAFSRMPNQPKTYVQHVMEQD
GKKLIELLDQGAHFYICGDGSQMAPAVEATLMKSYADVHQVSEADARLWLQQLEEKGRYAKDVWAG

FL#50 engineered    SEQ ID NO:11
mTIKEMPQPKTFGELKNLPLLNTDKPVQALMKIADELGEIFKFEAPGRVTRYLSSQRLIKEACDESRFDKNL
SQALKFARDFGGDGLVTSWTHEKNWKKAHNILLPSFSQQAMKGYHAMMVDIAVQLVQKWERLNADEHI
EVSEDMTRLTLDTIGLCGFNYRFNSFYRDQPHPFIISMVRALDEVMNKLQRANPDDPAYDENKRQCQEDI
KVMNDLVDKIIADRKARGEQSDDLLTQMLNGKDPETGEPLDDGNISYQIITFLIAGHETTSGLLSFALYFLVK
NPHVLQKVAEEAARVLVDPVPSYKQVKQLKYVGMVLNEALRLWPTVPAFSLYAKEDTVLGGEYPLEKGD
EVMVLIPQLHRDKTIWGDDVEEFRPERFENPSAIPQHAFKPFGNGQRACIGQQFALHEATLVLGMMLKHF
DFEDHTNYELDIKETLTLKPEGFVVKAKSKKIPLGGIPSPSTEQSAKKVRKKAENAHNTPLLVLYGSNMGT
AEGTARDLADIAMSKGFAPQVATLDSHAGNLPREGAVLIVTASYNGHPPDNAKQFVDWLDQASADEVKG
VRYSVFGCGDKNWATTYQKVPAFIDETLAAKGAENIADRGEADASDDFEGTYEEWREHMWSDVAAYFN
LDIENSEDNKSTLSLQFVDSAADMPLAKMHGAFSTNVVASKELQQPGSARSTRHLEIELPKEASYQEGDH
LGVIPRNYEGIVNRVTARFGLDASQQIRLEAEEEKLAHLPLAKTVSVEELLQYVELQDPVTRTQLRAMAAK
TVCPPHKVELEALLEKQAYKEQVLAKRLTMLELLEKYPACEMKFSEFIALLPSIRPRYYSISSSPRVDEKQA
SITVSVVSGEAWSGYGEYKGIASNYLAELQEGDTITCFISTPQSEFTLPKDPETPLIMVGPGTGVAPFRGF
VQARKQLKEQGQSLGEAHLYFGCRSPHEDYLYQEELENAQSEGIITLHTAFSRMPNQPKTYVQHVMEQD
GKKLIELLDQGAHFYICGDGSQMAPAVEATLMKSYADVHQVSEADARLWLQQLEEKGRYAKDVWAG

FL#51 engineered    SEQ ID NO:12
mTIKEMPQPKTFGELKNLPLLNTDKPVQALMKIADELGEIFKFEAPGRVTRYLSSQRLIKEACDESRFDKNL
SQALKFARDFGGDGLVTSWTHEKNWKKAHNILLPSFSQQAMKGYHAMMVDIAVQLVQKWERLNADEHI
EVSEDMTRLTLDTIGLCGFNYRFNSFYRDQPHPFIISMVRALDEVMNKLQRANPDDPAYDENKRQCQEDI
KVMNDLVDKIIADRKARGEQSDDLLTQMLNGKDPETGEPLDDGNISYQIITFLIAGHETTSGLLSFALYFLVK
NPHVLQKVAEEAARVLVDPVPSYKQVKQLKYVGMVLNEALRLWPTVPAFSLYAKEDTVLGGEYPLEKGD
EVMVLIPQLHRDKTIWGDDVEEFRPERFENPSAIPQHAFKPFGNGQRACIGQQFALHEATLVLGMMLKHF
DFEDHTNYELDIKETLTLKPEGFVVKAKSKKIPLGGIPSPSTEQSAKKVRKKAENAHNTPLLVLYGSNMGT
AEGTARDLADIAMSKGFAPQVATLDSHAGNLPREGAVLIVTASYNGHPPDNAKQFVDWLDQASADEVKG
VRYSVFGCGDKNWATTYQKVPAFIDETLAAKGAENIADRGEADASDDFEGTYEEWREHMWSDVAAYFN
LDIENSEDNKSTLSLQFVDSAADMPLAKMHGAFSTNVVASKELQQPGSARSTRHLEIELPKEASYQEGDH
LGVIPRNYEGIVNRVTARFGLDASQQIRLEAEEEKLAHLPLAKTVSVEELLQYVELQDPVTRTQLRAMAAK
TVCPPHKVELEALLEKQAYKEQVLAKRLTMLELLEKYPACEMKFSEFIALLPSIRPRYYSISSSPRVDEKQA
SITVSVVSGEAWSGYGEYKGIASNYLAELQEGDTITCFISTPQSEFTLPKDPETPLIMVGPGTGVAPFRGF
VQARKQLKEQGQSLGEAHLYFGCRSPHEDYLYQEELENAQSEGIITLHTAFSRMPNQPKTYVQHVMEQD
GKKLIELLDQGAHFYICGDGSQMAPAVEATLMKSYADVHQVSEADARLWLQQLEEKGRYAKDVWAG

FIG. 17-4

FL#51 engineered    SEQ ID NO:13
mTIKEMPQPKTFGELKNLPLLNTDKPVQALMKIADELGEIFKFEAPGCVTRYISSQRLIKEACDESRFDKNL
SQALKFFRDFSGDGLFTSWTHEINWKKAHNILLPSFSQQAMKGYHAMMVDIAVQLVQKWERLNADEHIE
VSEDMTRLTLDTIGLCGFNYRFNSFYRDQPHPFIISMVRALDEVMNKPQRANPDDPAYDENKRQCQEDIK
VMNDLVDKIIADRKARGEQSDDLLTQMLNGKDPETGEPLDDGNISYQIITFLIAGHETTSGLLSFALYFLVK
NPHVLQKVAEEAARVLVDPVPSYKQVKQLKYVGMVLNEALRLWPTFPAFSLYAKEDTVLGGEYPLEKGD
EVMVLIPQLHRDKTVWGDDVEEFRPERFENPSAIPQHAFKPFGNGQRACIGQQFALHEATLVLGMMLKH
FDFEDHTNYELDIKETLTLKPEGFVVKAKSKKIPLGGIPSPSTGQSAKKVRKKAENAHNTPLLVLYGSNMG
TAEGTARDLADIAMSKGFAPQVATLDSHAGNLPREGAVLIVTASYNGHPPDNAKQFVDWLDQYGSADEVK
GVRYSVFGCGDKNWATTYQKVPAFIDETLAAKGAENIADRGEADASDDFEGTYEEWREHMWSDVAAYF
NLDIENSEDNKSTLSLQFVDSAADMPLAKMHGAFSTNVVASKELQQPGSARSTRHLEIELPKEASYQEGD
HLGVIPRNYEGTVNRVTARFGLDASQQIRLEAEEEKLAHLPLAKTVSVEELLQYVELQDPVTRTQLRAMAA
KTVCPPHKVELEALLEKQAYKEQVLAKRLTMLELLEKYPACEMKFSEFIALLPSIRPRYYSISSSPRVDEKQ
ASITVSVVSGEAWSGYGEYKGIASNYLAELQEGDTITCFISTPQSEFTLPKDPETPLIMVGPGTGVAPFRG
FVQARKQLKEQGQSLGEAHLYFGCRSPHEDYLYQEELENAQSEGIITLHTAFSRMPNQPKTYVQHVMEQ
DGKKLIELLDQGAHFYICGDGSQMAPAVE ATLMKSYADVHQVSEADARLWLQQLEEKGRYAKDVWAG

FL#60 engineered    SEQ ID NO:14
mTIKEMPQPKTFGELKNLPLLNTDKPVQALMKIADELGEIFKFEAPGRVTRYLSSQRLIKEACDESRFDKNL
SQALKFARDPLGDGLATSWTHEKNWKKAHNILLPSFSQQAMKGYHAMMVDIAVQLVQKWERLNADEHIE
VSEDMTRLTLDTIGLCGFNYRFNSFYRDQPHPFIISMVRTLDEVMNKLQRANPDDPVYDENKRQCQEDIK
VMNDLVDKIIADRKARGEQSDDLLTQMLNGKDPETGEPLDDGNISYQIITFLIAGHETTSGLLSFALYFLVK
NPHVLQKVAEEAARVLVDPVPSYKQVKQLKYVGMVLNEALRLWPTAPAFSLYAKEDTVLGGEYPLEKGD
EVMVLIPQLHRDKTIWGDDVEEFRPERFENPSAIPQHAFKPFGNGQRACIGQQFALHEATLVLGMMLKHF
DFEDHTNYELDIKETLTLKPEGFVVKAKSKKIPLGGIPSPSTEQSAKKVRKKAENAHNTPLLVLYGSNMGT
AEGTARDLADIAMSKGFAPQVATLDSHAGNLPREGAVLIVTASYNGHPPDNAKQFVDWLDQASADEVKG
VRYSVFGCGDKNWATTYQKVPAFIDETLAAKGAENIADRGEADASDDFEGTYEEWREHMWSDVAAYFN
LDIENSEDNKSTLSLQFVDSAADMPLAKMHGAFSTNVVASKELQQPGSARSTRHLEIELPKEASYQEGDH
LGVIPRNYEGIVNRVTARFGLDASQQIRLEAEEEKLAHLPLAKTVSVEELLQYVELQDPVTRTQLRAMAAK
TVCPPHKVELEALLEKQAYKEQVLAKRLTMLELLEKYPACEMKFSEFIALLPSIRPRYYSISSSPRVDEKQA
SITVSVVSGEAWSGYGEYKGIASNYLAELQEGDTITCFISTPQSEFTLPKDPETPLIMVGPGTGVAPFRGF
VQARKQLKEQGQSLGEAHLYFGCRSPHEDYLYQEELENAQSEGIITLHTAFSRMPNQPKTYVQHVMEQD
GKKLIELLDQGAHFYICGDGSQMAPAVEATLMKSYADVHQVSEADARLWLQQLEEKGRYAKDVWAG

FL#62 engineered    SEQ ID NO:15
mTIKEMPQPKTFGELKNLPLLNTDKPVQALMKIADELGEIFKFEAPGRVTRYLSSQRLIKEACDESRFDKNL
SQALKFARDSVGDGLATSWTHEKNWKKAHNILLPSFSQQAMKGYHAMMVDIAVQLVQKWERLNADEHIE
VSEDMTRLTLDTIGLCGFNYRFNSFYRDQPHPFIISMVRTLDEVMNKLQRANPDDPVYDENKRQCQEDIK
VMNDLVDKIIADRKARGEQSDDLLTQMLNGKDPETGEPLDDGNISYQIITFLIAGHETTSGLLSFALYFLVK
NPHVLQKVAEEAARVLVDPVPSYKQVKQLKYVGMVLNEALRLWPTAPAFSLYAKEDTVLGGEYPLEKGD
EVMVLIPQLHRDKTIWGDDVEEFRPERFENPSAIPQHAFKPFGNGQRACIGQQFALHEATLVLGMMLKHF
DFEDHTNYELDIKETLTLKPEGFVVKAKSKKIPLGGIPSPSTEQSAKKVRKKAENAHNTPLLVLYGSNMGT
AEGTARDLADIAMSKGFAPQVATLDSHAGNLPREGAVLIVTASYNGHPPDNAKQFVDWLDQASADEVKG
VRYSVFGCGDKNWATTYQKVPAFIDETLAAKGAENIADRGEADASDDFEGTYEEWREHMWSDVAAYFN
LDIENSEDNKSTLSLQFVDSAADMPLAKMHGAFSTNVVASKELQQPGSARSTRHLEIELPKEASYQEGDH
LGVIPRNYEGIVNRVTARFGLDASQQIRLEAEEEKLAHLPLAKTVSVEELLQYVELQDPVTRTQLRAMAAK
TVCPPHKVELEALLEKQAYKEQVLAKRLTMLELLEKYPACEMKFSEFIALLPSIRPRYYSISSSPRVDEKQA
SITVSVVSGEAWSGYGEYKGIASNYLAELQEGDTITCFISTPQSEFTLPKDPETPLIMVGPGTGVAPFRGF
VQARKQLKEQGQSLGEAHLYFGCRSPHEDYLYQEELENAQSEGIITLHTAFSRMPNQPKTYVQHVMEQD
GKKLIELLDQGAHFYICGDGSQMAPAVEATLMKSYADVHQVSEADARLWLQQLEEKGRYAKDVWAG

FIG. 17-5

CYP102A1(F87V,L188Q) engineered    SEQ ID NO:16
TIKEMPQPKTFGELKNLPLLNTDKPVQALMKIADELGEIFKFEAPGRVTRYLSSQRLIKEACDESRFDKNLS
QALKFVRDFAGDGLVTSWTHEKNWKKAHNILLPSFSQQAMKGYHAMMVDIAVQLVQKWERLNADEHIEV
PEDMTRLTLDTIGLCGFNYRFNSFYRDQPHPFITSMVRALDEAMNKQQRANPDDPAYDENKRQFQEDIK
VMNDLVDKIIADRKASGEQSDDLLTHMLNGKDPETGEPLDDENIRYQIITFLIAGHETTSGLLSFALYFLVKN
PHVLQKAAEEAARVLVDPVPSYKQVKQLKYVGMVLNEALRLWPTAPAFSLYAKEDTVLGGEYPLEKGDE
LMVLIPQLHRDKTIWGDDVEEFRPERFENPSAIPQHAFKPFGNGQRACIGQQFALHEATLVLGMMLKHFD
FEDHTNYELDIKETLTLKPEGFVVKAKSKKIPLGGIPSPSTEQSAKKVRKKAENAHNTPLLVLYGSNMGTA
EGTARDLADIAMSKGFAPQVATLDSHAGNLPREGAVLIVTASYNGHPPDNAKQFVDWLDQASADEVKGV
RYSVFGCGDKNWATTYQKVPAFIDETLAAKGAENIADRGEADASDDFEGTYEEWREHMWSDVAAYFNL
DIENSEDNKSTLSLQFVDSAADMPLAKMHGAFSTNVVASKELQQPGSARSTRHLEIELPKEASYQEGDHL
GVIPRNYEGIVNRVTARFGLDASQQIRLEAEEEKLAHLPLAKTVSVEELLQYVELQDPVTRTQLRAMAAKT
VCPPHKVELEALLEKQAYKEQVLAKRLTMLELLEKYPACEMKFSEFIALLPSIRPRYYSISSSPRVDEKQAS
ITVSVVSGEAWSGYGEYKGIASNYLAELQEGDTITCFISTPQSEFTLPKDPETPLIMVGPGTGVAPFRGFV
QARKQLKEQGQSLGEAHLYFGCRSPHEDYLYQEELENAQSEGIITLHTAFSRMPNQPKTYVQHVMEQDG
KKLIELLDQGAHFYICGDGSQMAPAVEATLMKSYADVHQVSEADARLWLQQLEEKGRYAKDVWAG

CYP102A1(A74G,F87V,L188Q) engineered    SEQ ID NO:17
TIKEMPQPKTFGELKNLPLLNTDKPVQALMKIADELGEIFKFEAPGRVTRYLSSQRLIKEACDESRFDKNLS
QGLKFVRDFAGDGLVTSWTHEKNWKKAHNILLPSFSQQAMKGYHAMMVDIAVQLVQKWERLNADEHIE
VPEDMTRLTLDTIGLCGFNYRFNSFYRDQPHPFITSMVRALDEAMNKQQRANPDDPAYDENKRQFQEDI
KVMNDLVDKIIADRKASGEQSDDLLTHMLNGKDPETGEPLDDENIRYQIITFLIAGHETTSGLLSFALYFLVK
NPHVLQKAAEEAARVLVDPVPSYKQVKQLKYVGMVLNEALRLWPTAPAFSLYAKEDTVLGGEYPLEKGD
ELMVLIPQLHRDKTIWGDDVEEFRPERFENPSAIPQHAFKPFGNGQRACIGQQFALHEATLVLGMMLKHF
DFEDHTNYELDIKETLTLKPEGFVVKAKSKKIPLGGIPSPSTEQSAKKVRKKAENAHNTPLLVLYGSNMGT
AEGTARDLADIAMSKGFAPQVATLDSHAGNLPREGAVLIVTASYNGHPPDNAKQFVDWLDQASADEVKG
VRYSVFGCGDKNWATTYQKVPAFIDETLAAKGAENIADRGEADASDDFEGTYEEWREHMWSDVAAYFN
LDIENSEDNKSTLSLQFVDSAADMPLAKMHGAFSTNVVASKELQQPGSARSTRHLEIELPKEASYQEGDH
LGVIPRNYEGIVNRVTARFGLDASQQIRLEAEEEKLAHLPLAKTVSVEELLQYVELQDPVTRTQLRAMAAK
TVCPPHKVELEALLEKQAYKEQVLAKRLTMLELLEKYPACEMKFSEFIALLPSIRPRYYSISSSPRVDEKQA
SITVSVVSGEAWSGYGEYKGIASNYLAELQEGDTITCFISTPQSEFTLPKDPETPLIMVGPGTGVAPFRGF
VQARKQLKEQGQSLGEAHLYFGCRSPHEDYLYQEELENAQSEGIITLHTAFSRMPNQPKTYVQHVMEQD
GKKLIELLDQGAHFYICGDGSQMAPAVEATLMKSYADVHQVSEADARLWLQQLEEKGRYAKDVWAG

CYP102A1(R47L,F87V,L188Q) engineered    SEQ ID NO:18
TIKEMPQPKTFGELKNLPLLNTDKPVQALMKIADELGEIFKFEAPGLVTRYLSSQRLIKEACDESRFDKNLS
QALKFVRDFAGDGLVTSWTHEKNWKKAHNILLPSFSQQAMKGYHAMMVDIAVQLVQKWERLNADEHIEV
PEDMTRLTLDTIGLCGFNYRFNSFYRDQPHPFITSMVRALDEAMNKQQRANPDDPAYDENKRQFQEDIK
VMNDLVDKIIADRKASGEQSDDLLTHMLNGKDPETGEPLDDENIRYQIITFLIAGHETTSGLLSFALYFLVKN
PHVLQKAAEEAARVLVDPVPSYKQVKQLKYVGMVLNEALRLWPTAPAFSLYAKEDTVLGGEYPLEKGDE
LMVLIPQLHRDKTIWGDDVEEFRPERFENPSAIPQHAFKPFGNGQRACIGQQFALHEATLVLGMMLKHFD
FEDHTNYELDIKETLTLKPEGFVVKAKSKKIPLGGIPSPSTEQSAKKVRKKAENAHNTPLLVLYGSNMGTA
EGTARDLADIAMSKGFAPQVATLDSHAGNLPREGAVLIVTASYNGHPPDNAKQFVDWLDQASADEVKGV
RYSVFGCGDKNWATTYQKVPAFIDETLAAKGAENIADRGEADASDDFEGTYEEWREHMWSDVAAYFNL
DIENSEDNKSTLSLQFVDSAADMPLAKMHGAFSTNVVASKELQQPGSARSTRHLEIELPKEASYQEGDHL
GVIPRNYEGIVNRVTARFGLDASQQIRLEAEEEKLAHLPLAKTVSVEELLQYVELQDPVTRTQLRAMAAKT
VCPPHKVELEALLEKQAYKEQVLAKRLTMLELLEKYPACEMKFSEFIALLPSIRPRYYSISSSPRVDEKQAS
ITVSVVSGEAWSGYGEYKGIASNYLAELQEGDTITCFISTPQSEFTLPKDPETPLIMVGPGTGVAPFRGFV
QARKQLKEQGQSLGEAHLYFGCRSPHEDYLYQEELENAQSEGIITLHTAFSRMPNQPKTYVQHVMEQDG
KKLIELLDQGAHFYICGDGSQMAPAVEATLMKSYADVHQVSEADARLWLQQLEEKGRYAKDVWAG

FIG. 17-6

CYP102A2 (from Bacillus subtilis)    SEQ ID NO:19
mKETSPIPQPKTFGPLGNLPLIDKDKPTLSLIKLAEEQGPIFQIHTPAGTTIVVSGHELVKEVCDEERFDKSIE
GALEKVRAFSGDGLFTSWTHEPNWRKAHNILMPTFSQRAMKDYHEKMVDIAVQLIQKWARLNPNEAVDV
PGDMTRLTLDTIGLCGFNYRFNSYYRETPHPFINSMVRALDEAMHQMQRLDVQDKLMVRTKRQFRYDIQ
TMFSLVDSIIAERRANGDQDEKDLLARMLNVEDPETGEKLDDENIRFQIITFLIAGHETTSGLLSFATYFLLK
HPDKLKKAYEEVDRVLTDAAPTYKQVLELTYIRMILNESLRLWPTAPAFSLYPKEDTVIGGKFPITTNDRISV
LIPQLHRDRDAWGKDAEEFRPERFEHQDQVPHHAYKPFGNGQRACIGMQFALHEATLVLGMILKYFTLID
HENYELDIKQTLTLKPGDFHISVQSRHQEAIHADVQAAEKAAPDEQKEKTEAKGASVIGLNNRPLLVLYGS
DTGTAEGVARELADTASLHGVRTKTAPLNDRIGKLPKEGAVVIVTSSYNGKPPSNAGQFVQWLQEIKPGE
LEGVHYAVFGCGDHNWASTYQYVPRFIDEQLAEKGATRFSARGEGDVSGDFEGQLDEWKKSMWADAIK
AFGLELNENADKERSTLSLQFVRGLGESPLARSYEASHASIAENRELQSADSDRSTRHIEIALPPDVEYQE
GDHLGVLPKNSQTNVSRILHRFGLKGTDQVTLSASGRSAGHLPLGRPVSLHDLLSYSVEVQEAATRAQIR
ELASFTVCPPHRRELEELSAEGVYQEQILKKRISMLDLLEKYEACDMPFERFLELLRPLKPRYYSISSSPRV
NPRQASITVGVVRGPAWSGRGEYRGVASNDLAERQAGDDVVMFIRTPESRFQLPKDPETPIIMVGPGTG
VAPFRGFLQARDVLKREGKTLGEAHLYFGCRNDRDFIYRDELERFEKDGIVTVHTAFSRKEGMPKTYVQH
LMADQADTLISILDRGGRLYVCGDGSKMAPDVEAALQKAYQAVHGTGEQEAQNWLRHLQDTGMYAKDV
WAG

CYP102A2(F88A) engineered   SEQ ID NO:20
mKETSPIPQPKTFGPLGNLPLIDKDKPTLSLIKLAEEQGPIFQIHTPAGTTIVVSGHELVKEVCDEERFDKSIE
GALEKVRAFSGDGLATSWTHEPNWRKAHNILMPTFSQRAMKDYHEKMVDIAVQLIQKWARLNPNEAVDV
PGDMTRLTLDTIGLCGFNYRFNSYYRETPHPFINSMVRALDEAMHQMQRLDVQDKLMVRTKRQFRYDIQ
TMFSLVDSIIAERRANGDQDEKDLLARMLNVEDPETGEKLDDENIRFQIITFLIAGHETTSGLLSFATYFLLK
HPDKLKKAYEEVDRVLTDAAPTYKQVLELTYIRMILNESLRLWPTAPAFSLYPKEDTVIGGKFPITTNDRISV
LIPQLHRDRDAWGKDAEEFRPERFEHQDQVPHHAYKPFGNGQRACIGMQFALHEATLVLGMILKYFTLID
HENYELDIKQTLTLKPGDFHISVQSRHQEAIHADVQAAEKAAPDEQKEKTEAKGASVIGLNNRPLLVLYGS
DTGTAEGVARELADTASLHGVRTKTAPLNDRIGKLPKEGAVVIVTSSYNGKPPSNAGQFVQWLQEIKPGE
LEGVHYAVFGCGDHNWASTYQYVPRFIDEQLAEKGATRFSARGEGDVSGDFEGQLDEWKKSMWADAIK
AFGLELNENADKERSTLSLQFVRGLGESPLARSYEASHASIAENRELQSADSDRSTRHIEIALPPDVEYQE
GDHLGVLPKNSQTNVSRILHRFGLKGTDQVTLSASGRSAGHLPLGRPVSLHDLLSYSVEVQEAATRAQIR
ELASFTVCPPHRRELEELSAEGVYQEQILKKRISMLDLLEKYEACDMPFERFLELLRPLKPRYYSISSSPRV
NPRQASITVGVVRGPAWSGRGEYRGVASNDLAERQAGDDVVMFIRTPESRFQLPKDPETPIIMVGPGTG
VAPFRGFLQARDVLKREGKTLGEAHLYFGCRNDRDFIYRDELERFEKDGIVTVHTAFSRKEGMPKTYVQH
LMADQADTLISILDRGGRLYVCGDGSKMAPDVEAALQKAYQAVHGTGEQEAQNWLRHLQDTGMYAKDV
WAG

CYP102A3 (from Bacillus subtilis)    SEQ ID NO:21
mKQASAIPQPKTYGPLKNLPHLEKEQLSQSLWRIADELGPIFRFDFPGVSSVFVSGHNLVAEVCDEKRFD
KNLGKGLQKVREFGGDGLFTSWTHEPNWQKAHRILLPSFSQKAMKGYHSMMLDIATQLIQKWSRLNPNE
EIDVADDMTRLTLDTIGLCGFNYRFNSFYRDSQHPFITSMLRALKEAMNQSKRLGLQDKMMVKTKLQFQK
DIEVMNSLVDRMIAERKANPDENIKDLLSLMLYAKDPVTGETLDDENIRYQIITFLIAGHETTSGLLSFAIYCL
LTHPEKLKKAQEEADRVLTDDTPEYKQIQQLKYIRMVLNETLRLYPTAPAFSLYAKEDTVLGGEYPISKGQ
PVTVLIPKLHRDQNAWGPDAEDFRPERFEDPSSIPHHAYKPFGNGQRACIGMQFALQEATMVLGLVLKHF
ELINHTGYELKIKEALTIKPDDFKITVKPRKTAAINVQRKEQADIKAETKPKETKPKHGTPLLVLFGSNLGTAE
GIAGELAAQGRQMGFTAETAPLDDYIGKLPEEGAVVIVTASYNGAPPDNAAGFVEWLKELEEGQLKGVSY
AVFGCGNRSWASTYQRIPRLIDDMMKAKGASRLTAIGEGDAADDFESHRESWENRFWKETMDAFDINEI
AQKEDRPSLSITFLSEATETPVAKAYGAFEGIVLENRELQTAASTRSTRHIELEIPAGKTYKEGDHIGILPKN
SRELVQRVLSRFGLQSNHVIKVSGSAHMAHLPMDRPIKVVDLLSSYVELQEPASRLQLRELASYTVCPPH
QKELEQLVSDDGIYKEQVLAKRLTMLDFLEDYPACEMPFERFLALLPSLKPRYYSISSSPKVHANIVSMTV
GVVKASAWSGRGEYRGVASNYLAELNTGDAAACFIRTPQSGFQMPNDPETPMIMVGPGTGIAPFRGFIQ
ARSVLKKEGSTLGEALLYFGCRRPDHDDLYREELDQAEQDGLVTIRRCYSRVENEPKGYVQHLLKQDTQ
KLMTLIEKGAHIYVCGDGSQMAPDVERTLRLAYEAEKAASQEESAVWLQKLQDQRRYVKDVWTG

FIG. 17-7

CYP102A3(F88A) engineered    SEQ ID NO:22
mKQASAIPQPKTYGPLKNLPHLEKEQLSQSLWRIADELGPIFRFDFPGVSSVFVSGHNLVAEVCDEKRFD
KNLGKGLQKVREFGGDGLATSWTHEPNWQKAHRILLPSFSQKAMKGYHSMMLDIATQLIQKWSRLNPNE
EIDVADDMTRLTLDTIGLCGFNYRFNSFYRDSQHPFITSMLRALKEAMNQSKRLGLQDKMMVKTKLQFQK
DIEVMNSLVDRMIAERKANPDENIKDLLSLMLYAKDPVTGETLDDENIRYQIITFLIAGHETTSGLLSFAIYCL
LTHPEKLKKAQEEADRVLTDDTPEYKQIQQLKYIRMVLNETLRLYPTAPAFSLYAKEDTVLGGEYPISKGQ
PVTVLIPKLHRDQNAWGPDAEDFRPERFEDPSSIPHHAYKPFGNGQRACIGMQFALQEATMVLGLVLKHF
ELINHTGYELKIKEALTIKPDDFKITVKPRKTAAINVQRKEQADIKAETKPKETKPKHGTPLLVLFGSNLGTAE
GIAGELAAQGRQMGFTAETAPLDDYIGKLPEEGAVVIVTASYNGAPPDNAAGFVEWLKELEEGQLKGVSY
AVFGCGNRSWASTYQRIPRLIDDMMKAKGASRLTAIGEGDAADDFESHRESWENRFWKETMDAFDINEI
AQKEDRPSLSITFLSEATETPVAKAYGAFEGIVLENRELQTAASTRSTRHIELEIPAGKTYKEGDHIGILPKN
SRELVQRVLSRFGLQSNHVIKVSGSAHMAHLPMDRPIKVVDLLSSYVELQEPASRLQLRELASYTVCPPH
QKELEQLVSDDGIYKEQVLAKRLTMLDFLEDYPACEMPFERFLALLPSLKPRYYSISSSPKVHANIVSMTV
GVVKASAWSGRGEYRGVASNYLAELNTGDAAACFIRTPQSGFQMPNDPETPMIMVGPGTGIAPFRGFIQ
ARSVLKKEGSTLGEALLYFGCRRPDHDDLYREELDQAEQDGLVTIRRCYSRVENEPKGYVQHLLKQDTQ
KLMTLIEKGAHIYVCGDGSQMAPDVERTLRLAYEAEKAASQEESAVWLQKLQDQRRYVKDVWTG

CYP102A4 (from Bacillus anthracis str. Ames)    SEQ ID NO:23
mDKKVSAIPQPKTYGPLGNLPLIDKDKPTLSFIKLAEEYGPIFRMQTLSDTIIVVSGHELVAEVCDETRFDKS
IEGALAKVRAFAGDGLFTSETQEPNWQKAHNILMPTFSQRAMKDYHAMMVDIAVQLVQKWARLNPNENV
DVPEDMTRLTLDTIGLCGFNYRFNSFYRETPHPFITSMTRALDEAMHQLQRLDIEDKLMWRTKRQFQHDI
QSMFSLVDNIIAERKSSENQEENDLLSRMLNVQDPETGEKLDDENIRFQIITFLIAGHETTSGLLSFAIYFLLK
NPDKLKKAYEEVDRVLTDSTPTYQQVMKLKYIRMILNESLRLWPTAPAFSLYAKEDTVIGGKYPIKKGEDRI
SVLIPQLHRDKDAWGDNVEEFQPERFEELDKVPHHAYKPFGNGQRACIGMQFALHEATLVMGMLLQHFE
FIDYEEYQLDVKQTLTLKPGDFKIRIVPRNQTISHTTVLAPTEEKLKNHEIKQQVQKTPSIIGADNLSLLVLYG
SDTGVAEGIARELADTASLEGVQTEVAALNDRIGSLPKEGAVLIVTSSYNGKPPSNAGQFVQWLEELKGD
ELKGVQYAVFGCGDHNWASTYQRIPRYIDEQMAQKGATRFSTRGEADASGDFEEQLEQWKQRMWSDA
MKVFGLELNKNMEKERSTLSLQFVSRLGGSPLARTYEAVYASILENRELQSSSSERSTRHIEISLPEGATY
KEGDHLGVLPINSEKNVNRILKRFGLNGKDQVILSASGRSVNHIPLDSPVRLYDLLSYSVEVQEAATRAQIR
EMVTFTACPPHKKELESLLEDGVYQEQILKKRISMLDLLEKYEACEIRFEPFLELLPALKPRYYSISSSPLVA
QDRLSITVGVVNAPAWSGEGTYEGVASNYLAQRHNKDEIICFIRTPQSNFQLPENPETPIIMVGPGTGIAPF
RGFLQARRVQKQKGMNVGEAHLYFGCRHPEKDYLYRTELENDERDGLISLHTAFSRLEGQAKTYVQHVI
KEDRIHLISLLDNGAHLYICGDGSKMAPDVEDTLCQAYQEIHEVSEQEARNWLDRLQEEGRYGKDVWAGI

CYP102A5 (from Bacillus cereus)    SEQ ID NO:24
mDKKVSAIPQPKTYGPLGNLPLIDKDKPTLSFIKIAEEYGPIFQIQTLSDTIIVISGHELVAEVCDETRFDKSIE
GALAKVRAFAGDGLFTSETQEPNWKKAHNILMPTFSQRAMKDYHAMMVDIAVQLVQKWARLNPNENVD
VPEDMTRLTLDTIGLCGFNYRFNSFYRETPHPFITSMTRALDEAMHQLQRLDIEDKLMWRTKRQFQHDIQ
SMFSLVDNIIAERKSSGNQEENDLLSRMLHVQDPETGEKLDDENIRFQIITFLIAGHETTSGLLSFAIYFLLK
NPDKLKKAYEEVDRVLTDPTPTYQQVMKLKYIRMILNESLRLWPTAPAFSLYAKEDTVIGGKYPIKKGEDRI
SVLIPQLHRDKDAWGDNVEEFQPERFEDLDKVPHHAYKPFGNGQRACIGMQFALHEATLVMGMLLQHFE
FIDYEDYQLDVKQTLTLKPGDFKIRIVPRNQNISHTTVLAPTEEKLKNHEIKQQVQKTPSIIGADNLSLLVLYG
SDTGVAEGIARELADTASLEGVQTEVAALNDRIGSLPKEGAVLIVTSSYNGKPPSNAGQFVQWLEELKPD
ELKGVQYAVFGCGDHNWASTYQRIPRYIDEQMAQKGATRFSTRGEADASGDFEEQLEQWKESMWSDA
MKAFGLELNKNMEKERSTLSLQFVSRLGGSPLARTYEAVYASILENRELQSSSSERSTRHIEISLPEGATY
KEGDHLGVLPINSEKNVNRILKRFGLNGKDQVILSASGRSVNHIPLDSPVRLYDLLSYSVEVQEAATRAQIR
EMVTFTACPPHKKELESLLEDGVYHEQILKKRISMLDLLEKYEACEIRFERFLELLPALKPRYYSISSSPLIA
QDRLSITVGVVNAPAWSGEGTYEGVASNYLAQRHNKDEIICFIRTPQSNFQLPENPETPIIMVGPGTGIAPF
RGFLQARRVQKQKGMNLGEAHLYFGCRHPEKDYLYRTELENDERDGLISLHTAFSRLEGHPKTYVQHVI
KEDRMNLISLLDNGAHLYICGDGSKMAPDVEDTLCQAYQEIHEVSEQEARNWLDRLQDEGRYGKDVWA
GI

FIG. 17-8

CYP102A6 (from Bradyrhizobium japonicum)      SEQ ID NO:25
mSSKNRLDPIPQPPTKPVVGNMLSLDSAAPVQHLTRLAKELGPIFWLDMMGSPIVVVSGHDLVDELSDEK
RFDKTVRGALRRVRAVGGDGLFTADTREPNWSKAHNILLQPFGNRAMQSYHPSMVDIAEQLVQKWERL
NADDEIDVVHDMTALTLDTIGLCGFDYRFNSFYRRDYHPFVESLVRSLETIMMTRGLPFEQIWMQKRRKT
LAEDVAFMNKMVDEIIAERRKSAEGIDDKKDMLAAMMTGVDRSTGEQLDDVNIRYQINTFLIAGHETTSGL
LSYTLYALLKHPDILKKAYDEVDRVFGPDVNAKPTYQQVTQLTYITQILKEALRLWPPAPAYGISPLADETIG
GGKYKLRKGTFITILVTALHRDPSVWGPNPDAFDPENFSREAEAKRPINAWKPFGNGQRACIGRGFAMH
EAALALGMILQRFKLIDHQRYQMHLKETLTMKPEGFKIKVRPRADRERGAYGGPVAAVSSAPRAPRQPTA
RPGHNTPMLVLYGSNLGTAEELATRMADLAEINGFAVHLGALDEYVGKLPQEGGVLIICASYNGAPPDNA
TQFVKWLGSDLPKDAFANVRYAVFGCGNSDWAATYQSVPRFIDEQLSGHGARAVYPRGEGDARSDLDG
QFQKWFPAAAQVATKEFGIDWNFTRTAEDDPLYAIEPVAVTAVNTIVAQGGAVAMKVLVNDELQNKSGS
NPSERSTRHIEVQLPSNITYRVGDHLSVVPRNDPTLVDSVARRFGFLPADQIRLQVAEGRRAQLPVGEAV
SVGRLLSEFVELQQVATRKQIQIMAEHTRCPVTKPKLLAFVGEEAEPAERYRTEILAMRKSVYDLLLEYPA
CELPFHVYLEMLSLLAPRYYSISSSPSVDPARCSITVGVVEGPAASGRGVYKGICSNYLANRRASDAIYAT
VRETKAGFRLPDDSSVPIIMIGPGTGLAPFRGFLQERAARKAKGASLGPAMLFFGCRHPDQDFLYADELK
ALAASGVTELFTAFSRADGPKTYVQHVLAAQKDKVWPLIEQGAIIYVCGDGGQMEPDVKAALVAIRHEKS
GSDTATAARWIEEMGATNRYVLDVWAGG

CYP102A7 (from Bacillus licheniformis)         SEQ ID NO:26
mNKLDGIPIPKTYGPLGNLPLLDKNRVSQSLWKIADEMGPIFQFKFADAIGVFVSSHELVKEVSEESRFDK
NMGKGLLKVREFSGDGLFTSWTEEPNWRKAHNILLPSFSQKAMKGYHPMMQDIAVQLIQKWSRLNQDE
SIDVPDDMTRLTLDTIGLCGFNYRFNSFYREGQHPFIESMVRGLSEAMRQTKRFPLQDKLMIQTKRRFNS
DVESMFSLVDRIIADRKQAESESGNDLLSLMLHAKDPETGEKLDDENIRYQIITFLIAGHETTSGLLSFAIYLL
LKHPDKLKKAYEEADRVLTDPVPSYKQVQQLKYIRMILNESIRLWPTAPAFSLYAKEETVIGGKYLIPKGQS
VTVLIPKLHRDQSVWGEDAEAFRPERFEQMDSIPAHAYKPFGNGQRACIGMQFALHEATLVLGMILQYFD
LEDHANYQLKIKESLTLKPDGFTIRVRPRKKEAMTAMPGAQPEENGRQEERPSAPAAENTHGTPLLVLYG
SNLGTAEEIAKELAEEAREQGFHSRTAELDQYAGAIPAEGAVIIVTASYNGNPPDCAKEFVNWLEHDQTD
DLRGVKYAVFGCGNRSWASTYQRIPRLIDSVLEKKGAQRLHKLGEGDAGDDFEGQFESWKYDLWPLLR
TEFSLAEPEPNQTETDRQALSVEFVNAPAASPLAKAYQVFTAKISANRELQCEKSGRSTRHIEISLPEGAA
YQEGDHLGVLPQNSEVLIGRVFQRFGLNGNEQILISGRNQASHLPLERPVHVKDLFQHCVELQEPATRAQ
IRELAAHTVCPPHQRELEDLLKDDVYKDQVLNKRLTMLDLLEQYPACELPFARFLALLPPLKPRYYSISSSP
QLNPRQTSITVSVVSGPALSGRGHYKGVASNYLAGLEPGDAISCFIREPQSGFRLPEDPETPVIMVGPGT
GIAPYRGFLQARRIQRDAGVKLGEAHLYFGCRRPNEDFLYRDELEQAEKDGIVHLHTAFSRLEGRPKTYV
QDLLREDAALLIHLLNEGGRLYVCGDGSRMAPAVEQALCEAYRIVQGASREESQSWLSALLEEGRYAKD
VWDGGVSQHNVKADCIART

CYP102A8 (from Bacillus thuringiensis serovar konkukian)   SEQ ID NO:27
mDKKVSAIPQPKTYGPLGNLPLIDKDKPTLSFIKLAEEYGPIFQIQTLSDTIIVVSGHELVAEVCDETRFDKSI
EGALAKVRAFAGDGLFTSETDEPNWKKAHNILMPTFSQRAMKDYHAMMVDIAVQLVQKWARLNPNENV
DVPEDMTRLTLDTIGLCGFNYRFNSFYRETPHPFITSMTRALDEAMHQLQRLDIEDKLMWRTKRQFQHDI
QSMFSLVDNIIAERKSSENQEENDLLSRMLNVQDPETGEKLDDENIRFQIITFLIAGHETTSGLLSFAIYFLLK
NPDKLKKAYEEVDRVLTDSTPTYQQVMKLKYIRMILNESLRLWPTAPAFSLYAKEDTVIGGKYPIKKGEDRI
SVLIPQLHRDKDAWGDDVEEFQPERFEELDKVPHHAYKPFGNGQRACIGMQFALHEATLVMGMLLQHFE
FIDYEDYQLDVKQTLTLKPGDFKIRIVPRNQTISHTTVLAPTEEKLKKHEIKKQVQKTPSIIGADNLSLLVLYG
SDTGVAEGIARELADTASLEGVQTEVVALNDRIGSLPKEGAVLIVTSSYNGKPPSNAGQFVQWLEELKPD
ELKGVQYAVFGCGDHNWASTYQRIPRYIDEQMAQKGATRFSTRGEADASGDFEEQLEQWKQSMWSDA
MKAFGLELNKNMEKERSTLSLQFVSRLGGSPLARTYEAVYASILENRELQSSSSERSTRHIEISLPEGATY
KEGDHLGVLPINNEKNVNRILKRFGLNGKDQVILSASGRSVNHIPLDSPVRLYDLLSYSVEVQEAATRAQIR
EMVTFTACPPHKKELESLLEDGVYQEQILKKRISMLDLLEKYEACEIRFERFLELLPALKPRYYSISSSPLVA
QDRLSITVGVVNAPAWSGEGTYEGVASNYLAQRHNKDEIICFIRTPQSNFQLPENPETPIIMVGPGTGIAPF
RGFLQARRVQKQKGMKVGEAHLYFGCRHPEKDYLRTELENDERDGLISLHTAFSRLEGHPKTYVQHVI
KEDRIHLISLLDNGAHLYICGDGSKMAPDVEDTLCQAYQEIHEVSEQEARNWLDRLQEEGRYGKDVWAGI

FIG. 17-9

CYP102A9 (from Bacillus weihenstephanensis) SEQ ID NO:28
mDKKVSAIPQPKTYGLLGNLPLIDKDKPTLSFIKIAEEYGPIFRIQTLSDTIIVVSGHELVAEVCDETRFDKSIE
GALAKVRAFAGDGLFTSETHEPNWKKAHNILMPTFSQRAMKDYHAMMVDIAVQLVQKWARLNPNENVD
VPEDMTRLTLDTIGLCGFNYRFNSYYRETPHPFITSMSRALDEAMHQLQRLDIEDKLMWRTKRQFQHDIQ
SMFSLVDNIIAERKSSGNQEENDLLSRMLNVQDPETGEKLDDENIRFQIITFLIAGHETTSGLLSFAIYFLLK
NPDKLKKAYEEVDRVLTDPTPTYQQVMKLKYIRMILNESLRLWPTAPAFSLYAKEDTVIGGKYPIKKGEDRI
SVLIPQLHRDKDAWGDNVEEFQPERFEELDKIPHHAYKPFGNGQRACIGMQFALHEATLVMGMLLQHFE
FIDYQDYQLDVKQTLTLKPGDFKIRILPRNQTISHTTVLAPIEEKLKNDEIEQQVQKTPSIIGADNLSLLVLYG
SDTGVAEGIARELADTASLEGVQTEVVALNDRIGSLPKEGAVLIVTSSYNGKPPSNAGQFVQWLEELKSD
ELKGVQYAVFGCGDHNWASTYQRIPRYIDEQMAQKGATRFSTRGEADASGDFEEQLEQWKQSMWSDA
MKAFGLELNKNIEKERSTLSLQFVSRLGGSPLARTYEAVYASILENRELQSSSSERSTRHIEISLPEGATYQ
EGDHLGVLPINSEKNVNRILKRFGLNGKDQVILSASGRSVNHIPLDSPVSLFDLLSYSVEVQEAATRAQIRE
MVTFTACPPHKKELELLLEEGVYHEQILKKRMSMLDLLEKYEACEIRFERFLELLPALKPRYYSISSSPLVA
QDRLSITVGVVNAPAWSGEGTYEGVASNYLAQRHNKDEIICFIRTPQSNFQLPENPETPIIMVGPGTGVAP
FRGFLQARRVQKQKGINLGQAHLYFGCRHPEKDYLYRTELENDERDGLISLHIAFSRLEGYPKTYVQHLIK
QDRINLISLLDNGAHLYICGDGSKMAPDVEDTLCQAYQEIHEVSEQEARNWLDRVQEEGRYGKDVWAGI

CYP102A10 (from Erythrobacter litoralis)    SEQ ID NO:29
mDAPTALAPIPQPPGKPIVGNAFTVDSSRLIQSLMELAEEYGPIFQLEVMGTPLVFVSGADMVAEICDESR
FDKTVRGPLKRLRLIAGDGLFTGDTDDPNWAKAHHILLPSFSQKAMGSYLPMMTDIASQLMLKWERLNSD
DVIDVPMDMVRLTLDTIGVCGFGYRFNSFYREDFHPFIEALNRTLDTTQKMRGLPGEKLLKRQQIEQLNED
AAYMNNLVDEIIRERRQTGESGQGDLLDFMLSGRDPVTGERLSDENIRYQINTFLIAGHETTSGLLSFTLYY
LLKNRDVLQRAYAEVDEVLGRNIDQTPTLSQIGRLPYIRAILSEALRLWPTAPAMGLAPFEDEVLGGKYAIA
KGTFTTVLIPSLHRDKLVWGENPEAFNPDNFSPKAEAARPPHAYKPFGNGQRACIGRQFAIQESILVLGML
LQRFELFDHADYQLRIKETLSIKPDGFTIKARLRHDVERGGVATVEPESKTPDQAAAVPSHGTPLLVLYGS
NLGSSEGFARELAQRGEFSGFDVTMAPLDAHVAKLPTDGAVAIACASYNGMPPDNAAKFVDWLEQADA
ADAPLSNVSYLVLGCGNSDWAATFQVVPRKIDALMEQHGAERLVPAEELDARGDLDTQFHDWLDGLIPQ
LGDAFDIDLESGFDAVFEPLYTVEITDSITGNTVADRVGAREVEVVANRELKDTSKDEGRSTRHLEVRLPE
GMEYEPGDHLCVVPVNDPAVVDRLLKRFGLDRDTFVRIESRSDMRGPFPSGSTFSVLNLAETAGELQAV
ATRKDIATLARYSECPNSRAALEALAAPPSADGTDRYTSEVLEKRRSVLDMLEEFPACDVPLAVFLELIPFL
SPRYYSISSAPEANQGLCSITVGVVKGPALAGTGEFKGTCSAYLADLPPGDRFRAVVRKPTAQFRLPDNP
ETPVIMIGPGTGVAPFRAFLQRRDHLQEDGAVLGEAMLFFGCRHPDIDYLREELDDYDQRGVATVHAAF
SRHDGSRTYVQDLIAREADRVWELIEQDARIYVCGDGARMEPDVRKALMAIYAEKKSSDEASAKAWIDDL
VAQDRYLLDVWVG

CYP102A11 (from Erythrobacter)    SEQ ID NO:30
mATNATLTPIPQPPGKPLIGNALTVDASQQIQSLMELAEEYGPIFQLDMMGTPIVIISGADLVAEVCDEKRF
DKSVRGPLKRLRLIGGDGLFTGDTDAPNWSKAHNILLPSFSQKAMGSYLPMMTDIATQLVMKWERMNSD
DVIDVPKDMIRLTLDTIGVCGFGYRFNSFYREDFHPFIRALTRTLETTQKIRGIPGEKLLKGDAVKQLHRDA
KYMNNLVDEIIRERQRSGGDGPEDLLDFMLSGRDPLTGERLSDENIRYQINTFLIAGHETTSGLLSFTLYYL
LKNRDVLTRAYAEVDTVLGRNIDQPPSLKQIGQLPYIRAILFEALRLWPTAPAFGLAPFEDEVLGGKYLIPK
GTFTTVLIPSLHRDKSVWGENPEVFDPENFTAEAEAARPPHAYKPFGNGQRACIGRQFAIQESILVLAMIL
QRFELFDHSDYKLDIKETLSIKPDEFTIKARMRKDVERGGKATEDAEEASTEPAEPKVPKHDTPLLVLYGS
NLGSSESFAREVAQKGEFSGFEVEMAPLDDYVGKLPEDGAVAIACASYNGMPPDNAAKFIDWIEGKDGA
APDLSGVSYMMLGCGNSDWAATFQAVPRLIDARMEELGAKRIVPTTELDARSDVDTQFHTWLDALMPQL
GEHFDLDLSGEAAGIAEPLYKVEVTQSVTANTVASRVGAHAVKMVANRELKNTDIGEGRSTRHIEVELAQ
GETYQPGDHLCVVPENDDAVVERLLRRFNLDADTYVRIESRSEMRGPFPSGSTFSVYNLAKTAGELQAV
ATRKDIATLALYTECPNSKPALEKLAQPPQEDGTDQYATDVLAKRKSVLDLLEDYPACDLPLAVFLEMIPFL
SPRYYSISSAPGDTPQTCSITVGVKPALSGKGTFKGTCSNYLAELEPGASFNAVVREPTANFRLPDDP
KVPLIMVGPGTGLAPFRGFLQERDALASSGEELGPARLYFGCRTPDEDFLYRDELEDYDKRGIVTLRTAF
SRVDEGKCYVQDHIADDADAIWEMLEAGGRIYVCGDGARMEPDVRAALAKIHSDKTGSTPAEAQSWVG
DLITNERYSLDVWVG

FIG. 17-10

CYP102A12 (from Rhodopseudomonas palustris)      SEQ ID NO:31
mSSSNKLAPIPHPPKQPVVGNMLSIDTKAPVQHLVRLAEELGPIFWLDMMGAPIVIVSGYDLVDEISDEKR
FDKAVRGALRRVRTVGGDGLFTADTSEPNWSKAHNILLTPFGGRAMQSYHPSMVDIAEQLVKKWERLNA
DDEIDVVHDMTALTLDTIGLCGFDYRFNSFYRRDYHPFVESLVRSLETIMMTRGLPLENLWMKKRRDTLA
EDVAFMNAMVDEIIAERRKAAAVADKMDMLGAMMTGVDKVTGEPLDDVNIRYQINTFLIAGHETTSGLLS
CAIYALLKHPEVLQKAYDEVDRVLGADTSVEPSYQQVNQLGYITQILKETLRLWPPAPAYGVAPIQDETIG
GQYHLKRGTFTTVLVLALHRDPSIWGPNPDAFDPENFSREAESKRPANAWKPFGNGQRACIGRGFAMH
EAALALGMILQRFKLIDHTRYRMVLKETLTIKPEGFKIKVRPRSDKDRATRIASGVSHSVAPAPAAPRARPG
HNTPLLVLYGSNLGTAEELAHRVADLADLNGFATRLGALDQYVGQLPEEGGVLIFAASYNGAPPDNATQF
VRWLSGDLPPDAFAKLRYAVFGCGNRDWTATYQAIPRLIDERLAAHGGRNIFVRGEGDARDDLEGQFEA
WFATLGPLAVKEFGIDAAFDRGADDTPLYGIEPLAPAASQPLAATGVAVAMRVLENRELQDRAASGRSTR
HIEIALPQGMSYRVGDHLSVIPRNDPALVAAVAQRFGFAPDDQIRLSAAPGRRAQLPVGEAVSIGGLLGDH
VELQQVATRKQIVALAAHTRCPQTRPKLQALAGGDGAADDAYRAEVLGKRRSVFDLLQEHPACELPFAA
YLEMLTPLQPRYYSISSSPARDPARASVTVAVVEGPALSGRGIYRGACSSWLAGRGSGDTVQATVRATK
ACFRLPDDDRVPLIMIGPGTGVAPFRGFLQERSARKVGGATLGPALLFFGCRHPAQDYLYADELQGFAAD
GIVELHAAFSRGDGPKTYVQHLIAAQKDRVFALIEQGAIVYCGDGGRMEPDVKAALCAIHRERSGADAT
AAAAWIADLGARDRYVLDVWASV

CYP102A13 (from Rhodopseudomonas palustris)      SEQ ID NO:32
mPSTNKLDPIPHPPKKPVVGNMLSLDTTAPVQHLVRLAKELGPIFWLDMMGAPLVIVSGYDLVDEISDEKR
FDKAVRGALRRARAVGGDGLFTADTKEPNWSKAHNILLTPFGGRAMQSYHPSMVDIAEQLVKKWERLNA
DDEIDVVHDMTALTLDTIGLCGFDYRFNSFYRRDYHPFVESLVRSLETIMMTRGLPLENLWMKKRRETLA
DDVVFMNAMVDEIIAERRKASESAADKKDMLGAMLAGVDRATGEPLDDVNIRYQINTFLIAGHETTSGLLS
CAIYALLKHPDVLQKAYDEVDRVLGSDTAVRPSYQQVNQLSYITQILKETLRMWPPAPAYGVAPIKDEVIG
GKYHLKRGTFVTVLVLALHRDPAIWGPNPDAFDPENFSREAESKRPANAWKPFGNGQRACIGRGFAMH
EAALALGMILQRFQLIDHQRYRMVLKETLTIKPEGFKIKVRPRSDKDRGDFVAAGASQVSTPALAQAAPRA
RPDHNTPLLVLYGSNLGTAEELATRVADLAELNGFSTRLGALDQYVGHLPEEGGVLIFTASYNGAPPDNA
TQFVQWLSGDLPKDAFAKLRYAVFGCGNRDWTATYQAIPRLVDERLAAHGGRNIFLRGEGDARDDLEG
QFESWFAKLGPLAVKEFGIDAKFARAVDDAPLYRIEPVAPAAGNAVAAAGGAVPMKVLANRELQDCAAS
GRSTRHIEIALPEGISYRVGDHLSVMPRNDPALVAAVAQRLGFAPDDQIKLQVAPGRRAQLPIGEAISVGR
LLGDFVELQQVATRKQIAVMAEHTRCPQTRPKLQALAGGDGAADEAYRAGVLAKRKSVYDLMQEHPACE
LPLHAYLEMLSPLAPRYYSISSSPLRDPSRAAITVAVVDGPALSGRGHYRGVCSTWLAGRSVGDTIHATV
RATKAGFRLPDDDRVPLIMIGPGTGLAPFRGFLQERAARQQNGATLGPALLFFGCRHPAQDYLYADELQ
GFAAEGVVELHTAFSRGEGPKTYVQHLIAAQKDRVFTLIEQGAIIYVCGDGGKMEPDVRAALMAIHRERS
GADAAAASTWIDDLGACNRYVLDVWASA

CYP102A14 (from uncultured soil bacterium)      SEQ ID NO:33
mASNNKMSPIPQPPTRPVVGNMLSLDSAAPVQDLTRLAKELGPIFWLDMMGAPIVIVSGYTLVDELSVET
RLDKVVRGALRRVRAIGGDGLFTADTAEPNWSKARNILLQPFGNRAMQSYHPSMVDIAEQLVKKWERLN
ADDEIDVVHDMTALTLDTIGLCGFDYRFNSFYRRDYHPFVESLVRSLETIMMIRGLPLENFWMRRRRSDLA
TDVAFMNKMVDEIVAERRKSAEASDGKKDMLNAMMSGVDRSTGEQLDDVNIRYQINTFLIAGHETTSGLL
SYAIYALLKHPDVLKKAYAEVDRVLGADIEARPSYQQVTQLTYITQILKEALRLWPPAPAYGIAPLKDETIAG
GKYSLKKNTFISILVTALHHDPAVWGPNPDLFDPENFSPEAEAKRPVNAWRPFGNGQRACIGRGFAMHE
AALALGMILQRFKLIDHQRYQIRLKETLTIKPDGFKIKVRPRSGHDRTVHAEAATAAVATGAALPRARPRPG
HNTPLLVLYGSNLGTAEDLATRVADLAEVNGFATRLAPLDDCAGQLPDSGGVLIFCASYNGAPPDNATKF
VGWLRGELPNDAFAKLRYAVFGCGNRDWAATYQSVPRLIDETLSAHGGKRVFPRGEGDARSDLDGQFE
SWFAALGAAAVKEFGLESRFSRSADDAPLYSVEPVAPSAVNAVAALGGTVPMTILVSRELQNKSGPDASE
RSTRHIEVQLPGGMTYRVGDHLSVVPCNAPALVDRVARRFGFLPADQIRLAVAEGRRAQLPVGEAVSIGQ
LLTDFVELQQVATRKQIQIMSEHTRCPVTKPKLVAYVGDDADSSERYRADILSRRKSVYDLLEEFPAIELPF
PAYLEMLSLLAPRYYSISSSPTGDASRCSITVGVVSCPASSTGRGLYRGVCPYYLASRREGESVFATVRE
TKAGFRLPDDPSVPIIMIGPGTGLAPFRGFLQERAARKAGGATLGPAMLFFGCRHPEQDYLYADELKAFA
DEGITELFVAFSRSEGPKTYVQHLLATQKARVWDLIEQGAVIFVCGDGSKMEPDVKATLVQIYRDCTGAD
ANGGAKWIADLGAQNRYVLDVWAGG

FIG. 17-11

CYP102A15 (from Bacillus pumilus)   SEQ ID NO:34
mQQTSIIPKPKTYGPFKNIPHIKKGELSQTFWRLADELGPIFQFEFSKATSIFVSNHELFQEICDESRFDKYI
GTSLNKVRAFAGDGLFTSWTEEPNWRKAHHILMPAFSQQAMKGYHEMMLDIATQLVQKWQRTGRDEEI
EVAEDMTKLTLDTIGLCGFDFRFNSFYKENQHPFIESMVNGLSEAMDQASRLPVADKLMIKRRKKFEENV
DFMKQLVDDIIQERKKQDKTGDDLLSLMLHAKDPETGERLSDENIRYQIITFLIAGHETTSGLLSFAIYFLLK
NPEKLKKAVQEADDVLQGGLPTFKQVQKLNYTRMVLNESLRLWPTAPTFSLYAKEDTVIGGKYSIEKNQS
VSVLLPKLHRDQAVWGEDAEEEFKPERFLHPEKIPQHAYKPFGNGQRACIGMQFALHEATMVLAMVLHNL
ELIDHTSYELDLKESLTIKPNDFKIKVRPRKQQLFMVPPKEETKKSTTTDESKVKSHGTPLLVLYGSNLGTA
QQIANELAEEGKAKGFDVTTAPLDDYTRQLPDKGAVFIVTASYNGHPPDHAKKFVDWVTQEKEQDLTNVT
FAVFGCGDRNWASTYQRIPRLIDEALERKGAKRAADLGEGDAGGDMDEDKEAFQKTVFKQLAKEFQLTF
QEKGKENPKLSVAYTNELVERPVAKTYGAFSAVVLKNEELQSEKSERQTRHIELQLPEGKKYKEGDHIGIV
PKNSDALVQRVINRFNLDPKQHIKLYSEKKANHLPLDQPIQMRELLASHVELQEPATRTQLRELAAYTVCP
PHRVELEQMAGEAYQEAILKKRVTMLDLLDQYEACELSFVHFLALLPGLKPRYYSISSSPKVDEKRVSITV
AVVKGKAWSGRGEYAGVASNYLCGLKEGEEVACFLHEAQAGFQLPPSSEVPMIMIGPGTGIAPFRGFVQ
AREVWQKEGKPLGEAHLYFGCRHPHEDDLYFEEMQLAAQKGVVHIHRAYSRHKEQKVYVQHLLKEDGG
MLIKLLDQGAYLYVCGDGKVMAPDVEATLIDLYQHEKQCSKEAAENWLTTLANNNRYVKDVWS

P450 RHF (from Rhodococcus equi atcc 33707)   SEQ ID NO:35
mSACPIDHKALQNMGCPVSANAAAFDPFTGPYQVDPAASLRWSRDEEPVFYSPELGYWVVTRYEDVKS
VFRDNILFSPSIALEKITPVSEEATATLAKYDYAMARTMVNEDEPAHMPRRRALMDPFTPKELVHHEPMVR
RLTREYVDRFIDTGRADLVDEMLWEVPLTVALHFLGVPEEDMDELRSYSIAHTVNTWGRPAVEEQVAVAE
AVGKFWQYAGTVLEKMRKDPSGHGWMPFGIRVQQEQPDVVTDSYLHSMMMAGIVAAHETTANASANA
FRLLLENRSVWEEICADPSLIPNAVEECLRHSGSVAAWRRLVTDDTTIGGIDIPKGSKLLIVTSSANHDERH
FDNADDFDIRRENSSDHLTFGYGSHQCMGKNLARMEMQIFLEEFTKRIPHMELVPDQEFTYLPNTSFRGP
DHVLVQWDPAKNPERADPSILDERQPVKIGEPSKTNISRTVTVDAVTPVADGVVRVTLSDPSGKPLPKWT
PGSHIDVELGDLSRQYSLCSDPNDLSHYEIAVLEEPESRGGSRYVHRTLQAGHTLKMRGPRNHFKLDPD
AQRYIFVAGGIGITPVIAMADHAKATGKDYEIHYCGRDVATMALLDRLTADHGDKVEIHSSAAGNRLDIPAL
LATPVDGTQIYSCGPERLLTALEEATAHWPEDSLHVEHFTSNLATLDPANEHAFEVELRDSGLTIQVAADQ
TVLDALRASNIDIQSDCEEGLCGSCEAPVLDGEVDHRDMVLTKTERAQNKSMMTCCSRACGKKISLAL

CYP505X (from A. fumigatus Af293)   SEQ ID NO:36
mSESKTVPIPGPRGVPLLGNIYDIEQEVPLRSINLMADQYGPIYRLTTFGWSRVFVSTHELVDEVCDEERF
TKVVTAGLNQIRNGVHDGLFTANFPGEENWAIAHRVLVPAFGPLSIRGMFDEMYDIATQLVMKWARHGPT
VPIMVTDDFTRLTLDTIALCAMGTRFNSFYHEEMHPFVEAMVGLLQGSGDRARRPALLNNLPTSENSKYW
DDIAFLRNLAQELVEARRKNPEDKKDLLNALILGRDPKTGKGLTDESIIDNMITFLIAGHETTSGLLSFLFYYL
LKTPNAYKKAQEEVDSVVGRRKITVEDMSRLPYLNAVMRETLRLRSTAPLIAVHAHPEKNKEDPVTLGGG
KYVLNKDEPIVIILDKLHRDPQVYGPDAEEFKPERMLDENFEKLPKNAWKPFGNGMRACIGRPFAWQEAL
LVVAILLQNFNFQMDDPSYNLHIKQTLTIKPKDFHMRATLRHGLDATKLGIALSGSADRAPPESSGAASRV
RKQATPPAGQLKPMHIFFGSNTGTCETFARRLADDAVGYGFAADVQSLDSAMQNVPKDEPVVFITASYE
GQPPDNAAHFFEWLSALKENELEGVNYAVFGCGHHDWQATFHRIPKAVNQLVAEHGGNRLCDLGLADA
ANSDMFTDFDSWGESTFWPAITSKFGGGKSDEPKPSSSLQVEVSTGMRASTLGLQLQEGLVIDNQLLSA
PDVPAKRMIRFKLPSDMSYRCGDYLAVLPVNPTSVVRRAIRRFDLPWDAMLTIRKPSQAPKGSTSIPLDTP
ISAFELLSTYVELSQPASKRDLTALADAAITDADAQAELRYLASSPTRFTEEIVKKRMSPLDLLIRYPSIKLPV
GDFLAMLPPMRVRQYSISSSPLADPSECSITFSVLNAPALAAASLPPAERAEAEQYMGVASTYLSELKPGE
RAHIAVRPSHSGFKPPMDLKAPMIMACAGSGLAPFRGFIMDRAEKIRGRRSSVGADGQLPEVEQPAKAIL
YVVGCRTKGKDDIHATELAEWAQLGAVDVRWAYSRPEDGSKGRHVQDLMLEDREELVSLFDQGARIYVC
GSTGVGNGVRQACKDIYLERRRQLRQAARERGEEVPAEEDEDAAAEQFLDNLRTKERYATDVFT

FIG. 17-12

CYP 505A8 (from A. nidulans FGSC A4)    SEQ ID NO:37
mAEIPEPKGLPLIGNIGTIDQEFPLGSMVALAEEHGEIYRLRFPGRTVVVVSTHALVNETCDEKRFRKSVNS
ALAHVREGVHDGLFTAKMGEVNWEIAHRVLMPAFGPLSIRGMFDEMHDIASQLALKWARYGPDCPIMVT
DDFTRLTLDTLALCSMGYRFNSYYSPVLHPFIEAMGDFLTEAGEKPRRPPLPAVFFRNRDQKFQDDIAVL
RDTAQGVLQARKEGKSDRNDLLSAMLRGVDSQTGQKMTDESIMDNLITFLIAGHETTSGLLSFVFYQLLK
HPETYRTAQQEVDNVVGQGVIEVSHLSKLPYINSVLRETLRLNATIPLFTVEAFEDTLLAGKYPVKAGETIV
NLLAKSHLDPEVYGEDALEFKPERMSDELFNARLKQFPSAWKPFGNGMRACIGRPFAWQEALLVMAMLL
QNFDFSLADPNYDLKFKQTLTIKPKDMFMKARLRHGLTPTTLERRLAGLAVESATQDKIVTNPADNSVTGT
RLTILYGSNSGTCETLARRIAADAPSKGFHVMRFDGLDSGRSALPTDHPVVIVTSSYEGQPPENAKQFVS
WLEELEQQNESLQLKGVDFAVFGCFKEWAQTFHRIPKLVDSLLEKLGGSRLTDLGLADVSTDELFSTFET
WADDVLWPRLVAQYGADGKTQAHGSSAGHEAASNAAVEVTVSNSRTQALRQDVGQAMVVETRLLTAE
SEKERRKKHLEIRLPDGVSYTAGDYLAVLPINPPETVRRAMRQFKLSWDAQITIAPSGPTTALPTDGPIAAN
DIFSTYVELSQPATRKDLRIMADATTDPDVQKILRTYANETYTAEILTKSISVLDILEQHPAIDLPLGTFLLMLP
SMRMRQYSISSSPLLTPTTATITISVLDAPSRSRSNGSRHLGVATSYLDSLSVGDHLQVTVRKNPSSGFRL
PSEPETTPMICIAAGSGIAPFRAFLQERAVMMEQDKDRKLAPALLFFGCRAPGIDDLYREQLEEWQARGV
VDARWAFSRQSDDTKGCRHVDDRILADREDVVKLWRDGARVYVCGSGALAQSVRSAMVTVLRDEMET
TGDGSDNGKAEKWFDEQRNVRYVMDVFD

CYP 505A3 (from A. oryzae ATCC42149)    SEQ ID NO:38
mRQNDNEKQICPIPGPQGLPFLGNILDIDLDNGTMSTLKIAKTYYPIFKFTFAGETSIVINSVALLSELCDETR
FHKHVSFGLELLRSGTHDGLFTAYDHEKNWELAHRLLVPAFGPLRIREMFPQMHDIAQQLCLKWQRYGP
RRPLNLVDDFTRTTLDTIALCAMGYRFNSFYSEGDFHPFIKSMVRFLKEAETQATLPSFISNLRVRAKRRT
QLDIDLMRTVCREIVTERRQTNLDHKNDLLDTMLTSRDSLSGDALSDESIIDNILTFLVAGHETTSGLLSFAV
YYLLTTPDAMAKAAHEVDDVVGDQELTIEHLSMLKYLNAILRETLRLMPTAPGFSVTPYKPEIIGGKYEVKP
GDSLDVFLAAVHRDPAVYGSDADEFRPERMSDEHFQKLPANSWKPFGNGKRSCIGRAFAWQEALMILAL
ILQSFSLNLVDRGYTLKLKESLTIKPDNLWAYATPRPGRNVLHTRLALQTNSTHPEGLMSLKHETVESQPA
TILYGSNSGTCEALAHRLAIEMSSKGRFVCKVQPMDAIEHRRLPRGQPVIIITGSYDGRPPENARHFVKWL
QSLKGNDLEGIQYAVFGCGLPGHHDWSTTFYKIPTLIDTIMAEHGGARLAPRGSADTAEDDPFAELESWS
ERSVWPGLEAAFDLVRHNSSDGTGKSTRITIRSPYTLRAAHETAVVHQVRVLTSAETTKKVHVELALPDTI
NYRPGDHLAILPLNSRQSVQRVLSLFQIGSDTILYMTSSSATSLPTDTPISAHDLLSGYVELNQVATPTSLR
SLAAKATDEKTAEYLEALATDRYTTEVRGNHLSLLDILESYSVPSIEIQHYIQMLPLLRPRQYTISSSPRLNR
GQASLTVSVMERADVGGPRNCAGVASNYLASCTPGSILRVSLRQANPDFRLPDESCSHPIIMVAAGSGIA
PFRAFVQERSVRQKEGIILPPAFLFFGCRRADLDDLYREELDAFEEQGVVTLFRAFSRAQSESHGCKYVQ
DLLWMERVRVKTLWGQDAKVFVCGSVRMNEGVKAIISKIVSPTPTEELARRYIAETFI

CYP X (from A. oryzae ATCC42149)    SEQ ID NO:39
mSTPKAEPVPIPGPRGVPLMGNILDIESEIPLRSLEMMADTYGPIYRLTTFGFSRCMISSHELAAEVFDEER
FTKKIMAGLSELRHGIHDGLFTAHMGEENWEIAHRVLMPAFGPLNIQNMFDEMHDIATQLVMKWARQGP
KQKIMVTDDFTRLTLDTIALCAMGTRFNSFYSEEMHPFVDAMVGMLKTAGDRSRRPGLVNNLPTTENNKY
WEDIDYLRNLCKELVDTRKKNPTDKKDLLNALINGRDPKTGKGMSYDSIIDNMITFLIAGHETTSGSLSFAF
YNMLKNPQAYQKAQEEVDRVIGRRRITVEDLQKLPYITAVMRETLRLTPTAPAIAVGPHPTKNHEDPVTLG
NGKYVLGKDEPCALLLGKIQRDPKVYGPDAEEFKPERMLDEHFNKLPKHAWKPFGNGMRACIGRPFAW
QEALLVIAMLLQNFNFQMDDPSYNIQLKQTLTIKPNHFYMRAALREGLDAVHLGSALSASSSEHADHAAG
HGKAGAAKKGADLKPMHVYYGSNTGTCEAFARRLADDATSYGYSAEVESLDSAKDSIPKNGPVVFITASY
EGQPPDNAAHFFEWLSALKGDKPLDGVNYAVFGCGHHDWQTTFYRIPKEVNRLVGENGANRLCEIGLAD
TANADIVTDFDTWGETSFWPAVAAKFGSNTQGSQKSSTFRVEVSSGHRATTLGLQLQEGLVVENTLLTQ
AGVPAKRTIRFKLPTDTQYKCGDYLAILPVNPSTVVRKVMSRFDLPWDAVLRIEKASPSSSKHISIPMDTQV
SAYDLFATYVELSQPASKRDLAVLADAAAVDPETQAELQAIASDPARFAEISQKRISVLDLLLQYPSINLAIG
DFVAMLPPMRVRQYSISSSPLVDPTECSITFSVLKAPSLAALTKEDEYLGVASTYLSELRSGERVQLSVRP
SHTGFKPPTELSTPMIMACAGSGLAPFRGFVMDRAEKIRGRRSSGSMPEQPAKAILYAGCRTQGKDDIHA
DELAEWEKIGAVEVRRAYSRPSDGSKGTHVQDLMMEDKKELIDLFESGARIYVCGTPGVGNAVRDSIKS
MFLERREEIRRIAKEKGEPVSDDDEETAFEKFLDDMKTKERYTTDIFA

FIG. 17-13

CYP 505A1 (from F. oxysporum)      SEQ ID NO:40
mAESVPIPEPPGYPLIGNLGEFTSNPLSDLNRLADTYGPIFRLRLGAKAPIFVSSNSLINEVCDEKRFKKTLK
SVLSQVREGVHDGLFTAFEDEPNWGKAHRILVPAFGPLSIRGMFPEMHDIATQLCMKFARHGPRTPIDTS
DNFTRLALDTLALCAMDFRFYSYYKEELHPFIEAMGDFLTESGNRNRRPPFAPNFLYRAANEKFYGDIALM
KSVADEVVAARKASPSDRKDLLAAMLNGVDPQTGEKLSDENITNQLITFLIAGHETTSGTLSFAMYQLLKN
PEAYSKVQKEVDEVVGRGPVLVEHLTKLPYISAVLRETLRLNSPITAFGLEAIDDTFLGGKYLVKKGEIVTAL
LSRGHVDPVVYGNDADKFIPERMLDDEFARLNKEYPNCWKPFGNGKRACIGRPFAWQESLLAMVVLFQ
NFNFTMTDPNYALEIKQTLTIKPDHFYINATLRHGMTPTELEHVLAGNGATSSSTHNIKAAANLDAKAGSG
KPMAIFYGSNSGTCEALANRLASDAPSHGFSATTVGPLDQAKQNLPEDRPVVIVTASYEGQPPSNAAHFI
KWMEDLDGNDMEKVSYAVFACGHHDWVETFHRIPKLVDSTLEKRGGTRLVPMGSADAATSDMFSDFEA
WEDIVLWPGLKEKYKISDEESGGQKGLLVEVSTPRKTSLRQDVEEALVVAEKTLTKSGPAKKHIEIQLPSA
MTYKAGDYLAILPLNPKSTVARVFRRFSLAWDSFLKIQSEGPTTLPTNVAISAFDVFSAYVELSQPATKRNI
LALAEATEDKDTIQELERLAGDAYQAEISPKRVSVLDLLEKFPAVALPISSYLAMLPPMRVRQYSISSSPFA
DPSKLTLTYSLLDAPSLSGQGRHVGVATNFLSHLTAGDKLHVSVRASSEAFHLPSDAEKTPIICVAAGTGL
APLRGFIQERAAMLAAGRTLAPALLFFGCRNPEIDDLYAEEFERWEKMGAVDVRRAYSRATDKSEGCKY
VQDRVYHDRADVFKVWDQGAKVFICGSREIGKAVEDVCVRLAIEKAQQNGRDVTEEMARAWFERSRNE
RFATDVFD

CYP X (from G. moniliformis)  SEQ ID NO:41
mSATALFTRRSVSTSNPELRPIPGPKPLPLLGNLFDFDFDNLTKSLGELGKIHGPIYSITFGASTEIMVTSRE
IAQELCDETRFCKLPGGALDVMKAVVGDGLFTAETSNPKWAIAHRIITPLFGAMRIRGMFDDMKDICEQMC
LRWARFGPDEPLNVCDNMTKLTLDTIALCTIDYRFNSFYRENGAAHPFAEAVVDVMTESFDQSNLPDFVN
NYVRFRAMAKFKRQAAELRRQTEELIAARRQNPVDRDDLLNAMLSAKDPKTGEGLSPESIVDNLLTFLIAG
HETTSSLLSFCFYYLLENPHVLRRVQQEVDTVVGSDTITVDHLSSMPYLEAVLRETLRLRDPGPGFYVKPL
KDEVVAGKYAVNKDQPLFIVFDSVHRDQSTYGADADEFRPERMLKDGFDKLPPCAWKPFGNGVRACVG
RPFAMQQAILAVAMVLHKFDLVKDESYTLKYHVTMTVRPVGFTMKVRLRQGQRATDLAMGLHRGHSQE
ASAAASPSRASLKRLSSDVNGDDTDHKSQIAVLYASNSGSCEALAYRLAAEATERGFGIRAVDVVNNAID
RIPVGSPVILITASYNGEPADDAQEFVPWLKSLESGRLNGVKFAVFGNGHRDWANTLFAVPRLIDSELARC
GAERVSLMGVSDTCDSSDPFSDFERWIDEKLFPELETPHGPGGVKNGDRAVPRQELQVSLGQPPRITMR
KGYVRAIVTEARSLSSPGVPEKRHLELLLPKDFNYKAGDHVYILPRNSPRDVVRALSYFGLGEDTLITIRNT
ARKLSLGLPLDTPITATDLLGAYVELGRTASLKNLWTLVDAAGHGSRAALLSLTEPERFRAEVQDRHVSIL
DLLERFPDIDLSLSCFLPMLAQIRPRAYSFSSAPDWKPGHATLTYTVVDFATPATQGINGSSKSKAVGDGT
AVVQRQGLASSYLSSLGPGTSLYVSLHRASPYFCLQKSTSLPVIMVGAGTGLAPFRAFLQERRMAAEGAK
QRFGPALLFFGCRGPRLDSLYSVELEAYETIGLVQVRRAYSRDPSAQDAQGCKYVTDRLGKCRDEVARL
WMDGAQVLVCGGKKMANDVLEVLGPMLLEIDQKRGETTAKTVVEWRARLDKSRYVEEVYV

CYP 505A7 (from G. zeae PH1)     SEQ ID NO:42
mAESVPIPEPPGYPLIGNLGEFTSNPLSDLNRLADTYGPIFRLRLGAKAPIFVSSNSLINEVCDEKRFKKTLK
SVLSQVREGVHDGLFTAFEDEPNWGKAHRILVPAFGPLSIRGMFPEMHDIATQLCMKFARHGPRTPIDTS
DNFTRLALDTLALCAMDFRFYSYYKEELHPFIEAMGDFLTESGNRNRRPPFAPNFLYRAANEKFYGDIALM
KSVADEVVAARKASPSDRKDLLAAMLNGVDPQTGEKLSDENITNQLITFLIAGHETTSGTLSFAMYQLLKN
PEAYSKVQKEVDEVVGRGPVLVEHLTKLPYISAVLRETLRLNSPITAFGLEAIDDTFLGGKYLVKKGEIVTAL
LSRGHVDPVVYGNDADKFIPERMLDDEFARLNKEYPNCWKPFGNGKRACIGRPFAWQESLLAMVVLFQ
NFNFTMTDPNYALEIKQTLTIKPDHFYINATLRHGMTPTELEHVLAGNGATSSSTHNIKAAANLDAKAGSG
KPMAIFYGSNSGTCEALANRLASDAPSHGFSATTVGPLDQAKQNLPEDRPVVIVTASYEGQPPSNAAHFI
KWMEDLDGNDMEKVSYAVFACGHHDWVETFHRIPKLVDSTLEKRGGTRLVPMGSADAATSDMFSDFEA
WEDIVLWPGLKEKYKISDEESGGQKGLLVEVSTPRKTSLRQDVEEALVVAEKTLTKSGPAKKHIEIQLPSA
MTYKAGDYLAILPLNPKSTVARVFRRFSLAWDSFLKIQSEGPTTLPTNVAISAFDVFSAYVELSQPATKRNI
LALAEATEDKDTIQELERLAGDAYQAEISPKRVSVLDLLEKFPAVALPISSYLAMLPPMRVRQYSISSSPFA
DPSKLTLTYSLLDAPSLSGQGRHVGVATNFLSHLTAGDKLHVSVRASSEAFHLPSDAEKTPIICVAAGTGL
APLRGFIQERAAMLAAGRTLAPALLFFGCRNPEIDDLYAEEFERWEKMGAVDVRRAYSRATDKSEGCKY
VQDRVYHDRADVFKVWDQGAKVFICGSREIGKAVEDVCVRLAIEKAQQNGRDVTEEMARAWFERSRNE
RFATDVFD

FIG. 17-14

CYP 505C2 (from G. zeae PH1)      SEQ ID NO:43
mAIKDGGKKSGQIPGPKGLPVLGNLFDLDLSDSLTSLINIGQKYAPIFSLELGGHREVMICSRDLLDELCDE
TRFHKIVTGGVDKLRPLAGDGLFTAQHGNHDWGIAHRILMPLFGPLKIREMFDDMQDVSEQLCLKWARL
GPSATIDVANDFTRLTLDTIALCTMGYRFNSFYSNDKMHPFVDSMVAALIDADKQSMFPDFIGACRVKALS
AFRKHAAIMKGTCNELIQERRKNPIEGTDLLTAMMEGKDPKTGEGMSDDLIVQNLITFLIAGHETTSGLLSF
AFYYLLENPHTLEKARAEVDEVVGDQALNVDHLTKMPYVNMILRETLRLMPTAPGFFVTPHKDEIIGGKYA
VPANESLFCFLHLIHRDPKVWGADAEEFRPERMADEFFEALPKNAWKPFGNGMRGCIGREFAWQEAKLI
TVMILQNFELSKADPSYKLKIKQSLTIKPDGFNMHAKLRNDRKVSGLFKAPSLSSQQPSLSSRQSINAINAK
DLKPISIFYGSNTGTCEALAQKLSADCVASGFMPSKPLPLDMATKNLSKDGPNILLAASYDGRPSDNAEEF
TKWAESLKPGELEGVQFAVFGCGHKDWVSTYFKIPKILDKCLADAGAERLVEIGLTDASTGRLYSDFDDW
ENQKLFTELSKRQGVTPTDDSHLELNVTVIQPQNNDMGGNFKRAEVVENTLLTYPGVSRKHSLLLKLPKD
MEYTPGDHVLVLPKNPPQLVEQAMSCFGVDSDTALTISSKRPTFLPTDTPILISSLLSSLVELSQTVSRTSL
KRLADFADDDDTKACVERIAGDDYTVEVEEQRMSLLDILRKYPGINMPLSTFLSMLPQMRPRTYSFASAP
EWKQGHGMLLFSVVEAEEGTVSRPGGLATNYMAQLRQGDSILVEPRPCRPELRTTMMLPEPKVPIIMIAV
GAGLAPFLGYLQKRFLQAQSQRTALPPCTLLFGCRGAKMDDICRAQLDEYSRAGVVSVHRAYSRDPDSQ
CKYVQGLVTKHSETLAKQWAQGAIVMVCSGKKVSDGVMNVLSPILFAEEKRSGMTGADSVDVWRQNVP
KERMILEVFG

CYP 505A5 (from M. grisea 70-15 syn) SEQ ID NO:44
mFFLSSSLAYMAATQSRDWASFGVSLPSTALGRHLQAAMPFLSEENHKSQGTVLIPDAQGPIPFLGSVPL
VDPELPSQSLQRLARQYGEIYRFVIPGRQSPILVSTHALVNELCDEKRFKKKVAAALLGLREAIHDGLFTAH
NDEPNWGIAHRILMPAFGPMAIKGMFDEMHDVASQMILKWARHGSTTPIMVSDDFTRLTLDTIALCSMGY
RFNSFYHDSMHEFIEAMTCWMKESGNKTRRLLPDVFYRTTDKKWHDDAEILRRTADEVLKARKENPSGR
KDLLTAMIEGVDPKTGGKLSDSSIIDNLITFLIAGHETTSGMLSFAFYLLLKNPTAYRKAQQEIDDLCGREPIT
VEHLSKMPYITAVLRETLRLYSTIPAFVVEAIEDTVVGGKYAIPKNHPIFLMIAESHRDPKVYGDDAQEFEPE
RMLDGQFERRNREFPNSWKPFGNGMRGCIGRAFAWQEALLITAMLLQNFNFVMHDPAYQLSIKENLTLK
PDNFYMRAILRHGMSPTELERSISGVAPTGNKTPPRNATRTSSPDPEDGGIPMSIYYGSNSGTCESLAHK
LAVDASAQGFKAETVDVLDAANQKLPAGNRGPVVLITASYEGLPPDNAKHFVEWLENLKGGDELVDTSY
AVFGCGHQDWTKTFHRIPKLVDEKLAEHGAVRLAPLGLSNAAHGDMFVDFETWEFETLWPALADRYKTG
AGRQDAAATDLTAALSQLSVEVSHPRAADLRQDVGEAVVAARDLTAPGAPPKRHMEIRLPKTGGRVHY
SAGDYLAVLPVNPKSTVERAMRRFGLAWDAHVTIRSGGRTTLPTGAPVSAREVLSSYVELTQPATKRGIA
VLAGAVTGGPAAEQEQAKAALLDLAGDSYALEVSAKRVGVLDLLERFPACAVPFGTFLALLPPMRVRQYS
ISSSPLWNDEHATLTYSVLSAPSLADPARTHVGVASSYLAGLGEGDHLHVALRPSHVAFRLPSPETPVVC
VCAGSGMAPFRAFAQERAALVGAGRKVAPLLLFFGCREPGVDDLYREELEGWEAKGVLSVRRAYSRRT
EQSEGCRYVQDRLLKNRAEVKSLWSQDAKVFVCGSREVAEGVKEAMFKVVAGKEGSSEEVQAWYEEV
RNVRYASDIFD

CYP 505A2 (from N. crassa OR74 A)     SEQ ID NO:45
mSSDETPQTIPIPGPPGLPLVGNSFDIDTEFPLGSMLNFADQYGEIFRLNFPGRNTVFVTSQALVHELCDE
KRFQKTVNSALHEIRHGIHDGLFTARNDEPNWGIAHRILMPAFGPMAIQNMFPEMHEIASQLALKWARHG
PNQSIKVTDDFTRLTLDTIALCSMDYRFNSYYHDDMHPFIDAMASFLVESGNRSRRPALPAFMYSKVDRK
FYDDIRVLRETAEGVLKSRKEHPSERKDLLTAMLDGVDPKTGGKLSDDSIIDNLITFLIAGHETTSGLLSFAF
VQLLKNPETYRKAQKEVDDVCGKGPIKLEHMNKLHYIAAVLRETLRLCPTIPVIGVESKEDTVIGGKYEVSK
GQPFALLFAKSHVDPAVYGDTANDFDPERMLDENFERLNKEFPDCWKPFGNGMRACIGRPFAWQEALL
VMAVCLQNFNFMPEDPNYTLQYKQTLTTKPKGFYMRAMLRDGMSALDLERRLKGELVAPKPTAQGPVS
GQPKKSGEGKPISIYYGSNTGTCETFAQRLASDAEAHGFTATIIDSLDAANQNLPKDRPVVFITASYEGQP
PDNAALFVGWLESLTGNELEGVQYAVFGCGHHDWAQTFHRIPKLVDNTVSERGGDRICSLGLADAGKGE
MFTEFEQWEDEVFWPAMEEKYEVSRKEDDNEALLQSGLTVNFSKPRSSTLRQDVQEAVVVDAKTITAPG
APPKRHIEVQLSSDSGAYRSGDYLAVLPINPKETVNRVMRRFQLAWDTNITIEASRQTTILPTGVPMPVHD
VLGAYVELSQPATKKNILALAEAADNAETKATLRQLAGPEYTEKITSRRVSILDLLEQFPSIPLPFSSFLSLLP
PMRVRQYSISSSPLWNPSHVTLTYSLLESPSLSNPDKKHVGVATSYLASLEAGDKLNVSIRPSHKAFHLPV
DADKTPLIMIAAGSGLAPFRGFVQERAAQIAAGRSLAPAMLFYGCRHPEQDDLYRDEFDKWESIGAVSVR
RAFSRCPESQETKGCKYVGDRLWEDREEVTGLWDRGAKVYVCGSREVGESVKKVVVRIALERQKMIVE
AREKGELDSLPEGIVEGLKLKGLTVEDVEVSEERALKWFEGIRNERYATDVFD

FIG. 17-15

CYP102D1 (from Streptomyces avermitilis)     SEQ ID NO:46
mTTQPETDLRPIRSPRGVPLFGHTPQIPSTNPVEYFGKLSKQFPEGLYGMEIAGIEQVFVWDPDLVAEVC
DETRFFKQIDKTPLAHVRDYAGAGLFTAHQHEEEWGMAHRVLLPVFSQRAMKGYFGQMLEIAQNLVGK
WERKEGQPVNITDDYTRLTLDTIALSGFGYRFDSFAKEDLHPFLNALLQALVESLRRSQELPVMTKMRKA
DDKKYRENIRLMRDLVENVIKERREGKGTGEDDLLGLMLEATDPETGKGLDDDNVRDQVVTFLIAGHETT
SGLLSFATYSLMRNPHILAQAYAEVDRLLPGDTVPDYDTIMQMDVIPRILEETLRLWAPIPMIGKSPLEDTVI
GGCYGLKKGARVNILEGPLHTHPKAWERPEEFDINRWLPENRVNHHPHAYKPFGNGVRACIGRQFALTE
ARLALALVLQKFKFADTDDYKMDVKEALTRKPGGFELNVRARQEHERTVFGAADLQTDDTQAQAAVSGV
GVNLTVAYGSSLGSCEDLARTIADRGERSGFGTTLVGLDELGDNLPTEGLLVVVASSYNGKAPDNAQRF
DDLLAAGLPEGSLSNVRFALLGAGNTQWVATYQGFPKRIEAGLLAAGATRVIERGIADAAGDFDGMATR
WMDTLWTTLAEEYAADTSETTGPRFEVQLLTEAEVRPAIVSEQAYPLTVVANEELVSDATGLWDFSIEPP
RPAAKSITIELPDGVTYDTGNHLAVFAKNEPVLVNRALARLGVDRDQVLRLDQPGGGRTHLPVGTPVTTG
LLFTEFVELQDVATRSQIQELAEHTQCPWTRPQLQAYTADTAEAEERYQKEILGKRVSVLNLLERFPAVEL
PLAVFLEMMGPIRPRFYSISSSPLANPRHVRLTVGLLEGPALSGDGRYRGTCSSYIAGLESGDVFYGYVR
VPSPTFAPPADPATPLLLIGPGTGIAPLRGFLEERAHQHAHGTQVGLSQVFVGCRHPEHDYFYRQEMQD
WEQAGIAQVHTAFSAVTGHPARFVQDAIVGAADTVWQAIQDGAYVYVCGDGRRMAPAVREALAAIYRKH
TGSDDEAAQQWLAQLEADERYQQDVFA

CYP102E1 (from Ralstonia metallidurans)     SEQ ID NO:47
mSTATPAAALEPIPRDPGWPIFGNLFQITPGEVGQHLLARSRHHDGIFELDFAGKRVPFVSSVALASELCD
ATRFRKIIGPPLSYLRDMAGDGLFTAHSDEPNWGCAHRILMPAFSQRAMKAYFDVMLRVANRLVDKWDR
QGPDADIAVADDMTRLTLDTIALAGFGYDFASFASDELDPFVMAMVGALGEAMQKLTRLPIQDRFMGRAH
RQAAEDIAYMRNLVDDVIRQRRVSPTSGMDLLNLMLEARDPETDRRLDDANIRNQVITFLIAGHETTSGLL
TFALYELLRNPGVLAQAYAEVDTVLPGDALPVYADLARMPVLDRVLKETLRLWPTAPAFAVAPFDDVVLG
GRYRLRKDRRISVVLTALHRDPKVWANPERFDIDRFLPENEAKLPAHAYMPFGQGERACIGRQFALTEAK
LALALMLRNFAFQDPHDYQFRLKETLTIKPDQFVLRVRRRRPHERFVTRQASQAVADAAQTDVRGHGQA
MTVLCASSLGTARELAEQIHAGAIAAGFDAKLADLDDAVGVLPTSGLVVVVAATYNGRAPDSARKFEAML
DADDASGYRANGMRLALLGCGNSQWATYQAFPRRVFDFFITAGAVPLLPRGEADGNGDFDQAAERWLA
QLWQALQADGAGTGGLGVDVQVRSMAAIRAETLPAGTQAFTVLSNDELVGDPSGLWDFSIEAPRTSTRD
IRLQLPPGITYRTGDHIAVWPQNDAQLVSELCERLDLDPDAQATISAPHGMGRGLPIDQALPVRQLLTHFIE
LQDVVSRQTLRALAQATRCPFTKQSIEQLASDDAEHGYATKVVARRLGILDVLVEHPAIALTLQELLACTVP
MRPRLYSIASSPLVSPDVATLLVGTVCAPALSGRGQFRGVASTWLQHLPPGARVSASIRTPNPPFAPDPD
PAAPMLLIGPGTGIAPFRGFLEERALRKMAGNAVTPAQLYFGCRHPQHDWLYREDIERWAGQGVVEVHP
AYSVVPDAPRYVQDLLWQRREQVWAQVRDGATIYVCGDGRRMAPAVRQTLIEIGMAQGGMTDKAASD
WFGGLVAQGRYRQDVFN

CYP102F1 (from Actinosynnema pretiosum subsp. Auranticum) SEQ ID NO:48
mVATGTRIPGPKPLPLVGNLLDVLTSDLDTDVDFLDRCHREHGGIVALTFAGGQRQVFASSHELVARMCSD
PSWGKAVHPALEQVRDFAGDGLFTARGDEPNWGKAHRLLMPAFGPTAMRDHFPAMLDIAEQMLVRWR
RFGPDHRIDVADDMTRLTLDTIALCAFGARFNSFYRDRAHPFVDAMVRSLVEAGERAERLPGVQPFLVGR
NQRYRDDIATMNRIADGVVAARAALPAGERPDDLLERMLTCADPVTGERLSARNVRYQLATFLIAGHETTS
GLLSFAVHRLLAHPEVLRKAKDAVDGVLGDRVPAFEDLARLDYLGQVLRETLRLHPTAPAFALAPDEPAEL
GGHAIGAGEPVLVMLPTLHRDPAVWRDPDVFDPERFAPERMDEIPACAWMPFGHGARACIGRPFALQE
ATLVLALVLQRFDLALADPDHRLTIKQTLTLKPDSLVVRARPRADRPGATATVETVVPHQVPATHRHGTPL
HVFYGSNGGSGEGLARTIAGDGAARGWATSVAPLDDAVRALPASGPVVIVSSSYNGAPPDNAAHFVRW
LTQDGPDLSGVDYLVLGCGNLDWSATYQRVPTLIDEAMAAAGARRLRERGATDARADFFGDWERWYEP
LWPLLSAECGVEVGEIGPRFRVVESDAADGLGDLASAVVLENRELVRGPDAGSKRHLELRLPDGTSYRT
GDYLSVLPQNHPDLVRRAVARLGTRAERVVTVESSAPTGLVPVGRALRVDELLTRCVDLSAPAGAGVVA
RLAERCPCPPERAELAATTGATLLELLERFPSCAVDLALALELLPAPRTRLYSISSAAEEQRAEVALTVSVT
GVTSGYLSRVRPGDRVAVGIASPPESFRPPADNTVPVVLIAAGTGIAPFRGFLRARAALGGEPGPALLLFG
CRGPELDDLYAEEFAALGDWLEVDRAYSRHPDGEVRHVQHRLWQRRDRVRELVDAGARVYLCGDATR
VGPAVEEVLGRIGPGAGWLDALRAGGRYATDVF

FIG. 17-16

CYP102G2 (from Saccharopolyspora erythraea) SEQ ID NO:49
mTQTPLHHDDVPVADVSGTGLTATPTQQAMELARRHGPVFRRRTREFQSLLVSDVDLVAELSDEQRFAK
AVGPALENVREFAADGLFTAYNDEFNWAKAHDILMPAFALGSMRTYHPVMLRVARRLLDSWDRAAAASA
PVDVPDDMTRMTLDTIGLAGFGFDFGSFGRAEPHPFVGAMVRCLDWSMTRLSRVPGTDHSERDEAFRA
DARYLASVVDEVINTRAAEGDTSGEDLLGLMLGARHPADGTTLDAANIRNQIITFLIAGHETTSGTLSFALH
YLAKNPTVLRLVQREADELWGDSPDPEPSFEDIGRLTYTRQVLNETLRLWPSAPAFGRQARHDTVLGGRI
PMRAGEAAAVLIPMLHRSPVRGDNPELFDPARFAPEAEAARGPHAFKPFGTGERACIGRQFALDEATMV
LAMLAHRYRLVDHAGYRLKVKETLTLKPEGLTLAVRARTAADRVTNRLALPVGLPSAAPGEPADAARRPG
RVLPGTGLLLLHGSNYGTCRDFAAQLALAAGELGCDTAVAPLDEYAGNLPSDRPVIVVAASYNGRPTDDA
VSFSRWLDEAEPGAADGVDFAVLGVGDRNWAATYQHVPTRIDARLAELGGTRILERGEADASGDLAGAV
RRFSAALETALLERSGDPDAVAAAPEGDGPAYTVSEVTGGALDSLAARHGMVEMTVTEVADLTAPDYPR
TKRFVRLALPEGTAYRTADHLAVLPVHDAALVERAAGVLGVDLDTVLDIRAKRPGRLTFDRSLTVRELLSH
HVELQDPPTPDGLDALAALNPCPPERAALRGLAEEARSGTADHRTLWDLIEDHPALRDALSWSALLELLP
ATRPRQYSVSSSPAVDPRHVDLMVSVLRAPARSGRGEFRGAGSRHLSEVRPGDTVLARVQPCREDFRV
APDEPLIMVAAGTGLAPFRGVIADRRERVANGARQAPALCYFGCDAPDADYLHSAELRAAESAGAVAMR
PAFNEAPVGGQCFVQHRIAAEAGEVWALLESGARVLVCGDGRHMAPGVREAFRGIYRERTPGADDASA
HEWLQAMIAGGCYVEDVYAG

CYP102J1 (from Burkholderia)     SEQ ID NO:50
mKSSSLVPQPPLKPVIGHLMEVLGPSPLAKMMDLARTYGPVYWFEVFGQGYYVVSGQTLVDEVCDETRF
QKCVHQSLLELRPAIGDGLFTAFGDEPNWAKAHRVLMQAFGPLSIWSMFDKMVDIADQMFLHWERFGPE
TPVDVSDHMTRLTLDTIALCAFDCRFNSFYREDQHPFVDAMVNTLSEAGKRELRPKLVSKLMVKRSRQFD
ADIEVMRSLATKMIEDRRKNPHVNEESMDLLDRMLNGIDPVTGEKLDDENIVFQMITFLIAGHETTSGLLSF
ATYFLLKNPDILQKARDMVDEVVGSETPRIEHLARLRYVEQILMETLRIWPTAPGFAVKPLADTTFGGKYA
VSPDDIIMILTPMLHRDVSVWGEDVEAFRPERFAPENAEQLPPNSWKPFGNGARACIGRPFAMQEAHLVL
IMLLQRFDFSFADPDYELDVAETLTLKPAGFRVNVKPRARGALKVPDTALHARSNAQSPSVAPVQSIAPG
EDLSNLLVLFGGNTGSAESFARRIAGDASRHGFHATCAPLDDFAGKLGGYPAIVIVTASYEGQPPDNAKS
FVPYVEALDEGALDGVHFSVLGCGNKQWARTYQAIPKRVDEALEKAGATRVHFRGELDSGGDFFGEFD
RWYTEMWNRFAISAGKEIPVIQHDDVALKVSFAGSSREKVLNLGDMAHASIVDNRELVDISVAGSRSKKHI
ELKLPEAMTYRSGDYLAVLPRNAKNNVDRVLRRFRVSWDTQVVIEGTSSNPRLPLGQAIGCGELFSSYVE
LAVPATRSQVSSLAAATRCPPEKVELERLSADGFECEILGKRTTVMDLLERFGSVDLSLEKFLDMLPALKA
RQYSISSSPLWKADHVTLTVAVVDAPALSGNGRHEGVASSYLARLNTGDSLSVAVRPSNARFRPPAEPD
LPMILICAGSGIAPFRGFLQERALQKQRGENVGTSLLFFGIDDPDVDFLYRDELDEWARCGVVEVMPAYS
NRPEEGARFVQDKVWLERERISALFSQGATVFVCGDGKNMAPAVRATLGRIYQETTGENDESASAWIDT
MEREHGRYVADVFA

CYP101A1 (from Pseudomonas putida)         SEQ ID NO:51
mMTTETIQSNANLAPLPPHVPEHLVFDFDMYNPSNLSAGVQEAWAVLQESNVPDLVWTRCNGGHWIAT
RGQLIREAYEDYRHFSSECPFIPREAGEAYDFIPTSMDPPEQRQFRALANQVVGMPVVDKLENRIQELAC
SLIESLRPQGQCNFTEDYAEPFPIRIFMLLAGLPEEDIPHLKYLTDQMTRPDGSMTFAEAKEALYDYLIPIIE
QRRQKPGTDAISIVANGQVNGRPITSDEAKRMCGLLLVGGLDTVVNFLSFSMEFLAKSPEHRQELIERPE
RIPAACEELLRRFSLVADGRILTSDYEFHGVQLKKGDQILLPQMLSGLDERENACPMHVDFSRQKVSHTT
FGHGSHLCLGQHLARREIIVTLKEWLTRIPDFSIAPGAQIQHKSGIVSGVQALPLVWDPATTKAV

CYP101A1 (Y96A) engineered     SEQ ID NO:52
mTTETIQSNANLAPLPPHVPEHLVFDFDMYNPSNLSAGVQEAWAVLQESNVPDLVWTRCNGGHWIATR
GQLIREAYEDYRHFSSECPFIPREAGEAADFIPTSMDPPEQRQFRALANQVVGMPVVDKLENRIQELACS
LIESLRPQGQCNFTEDYAEPFPIRIFMLLAGLPEEDIPHLKYLTDQMTRPDGSMTFAEAKEALYDYLIPIIEQ
RRQKPGTDAISIVANGQVNGRPITSDEAKRMCGLLLVGGLDTVVNFLSFSMEFLAKSPEHRQELIERPERI
PAACEELLRRFSLVADGRILTSDYEFHGVQLKKGDQILLPQMLSGLDERENACPMHVDFSRQKVSHTTFG
HGSHLCLGQHLARREIIVTLKEWLTRIPDFSIAPGAQIQHKSGIVSGVQALPLVWDPATTKAV

CYP101A1 (Y96F) engineered     SEQ ID NO:53
mTTETIQSNANLAPLPPHVPEHLVFDFDMYNPSNLSAGVQEAWAVLQESNVPDLVWTRCNGGHWIATR
GQLIREAYEDYRHFSSECPFIPREAGEAFDFIPTSMDPPEQRQFRALANQVVGMPVVDKLENRIQELACS
LIESLRPQGQCNFTEDYAEPFPIRIFMLLAGLPEEDIPHLKYLTDQMTRPDGSMTFAEAKEALYDYLIPIIEQ
RRQKPGTDAISIVANGQVNGRPITSDEAKRMCGLLLVGGLDTVVNFLSFSMEFLAKSPEHRQELIERPERI
PAACEELLRRFSLVADGRILTSDYEFHGVQLKKGDQILLPQMLSGLDERENACPMHVDFSRQKVSHTTFG
HGSHLCLGQHLARREIIVTLKEWLTRIPDFSIAPGAQIQHKSGIVSGVQALPLVWDPATTKAV

FIG. 17-17

CYP101A1 (Y96F, F87W) engineered    SEQ ID NO:54
mTTETIQSNANLAPLPPHVPEHLVFDFDMYNPSNLSAGVQEAWAVLQESNVPDLVWTRCNGGHWIATR
GQLIREAYEDYRHFSSECPWIPREAGEAFDFIPTSMDPPEQRQFRALANQVVGMPVVDKLENRIQELACS
LIESLRPQGQCNFTEDYAEPFPIRIFMLLAGLPEEDIPHLKYLTDQMTRPDGSMTFAEAKEALYDYLIPIIEQ
RRQKPGTDAISIVANGQVNGRPITSDEAKRMCGLLLVGGLDTVVNFLSFSMEFLAKSPEHRQELIERPERI
PAACEELLRRFSLVADGRILTSDYEFHGVQLKKGDQILLPQMLSGLDERENACPMHVDFSRQKVSHTTFG
HGSHLCLGQHLARREIIVTLKEWLTRIPDFSIAPGAQIQHKSGIVSGVQALPLVWDPATTKAV

CYP101A1 (Y96F, V247L) engineered    SEQ ID NO:55
mTTETIQSNANLAPLPPHVPEHLVFDFDMYNPSNLSAGVQEAWAVLQESNVPDLVWTRCNGGHWIATR
GQLIREAYEDYRHFSSECPFIPREAGEAFDFIPTSMDPPEQRQFRALANQVVGMPVVDKLENRIQELACS
LIESLRPQGQCNFTEDYAEPFPIRIFMLLAGLPEEDIPHLKYLTDQMTRPDGSMTFAEAKEALYDYLIPIIEQ
RRQKPGTDAISIVANGQVNGRPITSDEAKRMCGLLLLGGLDTVVNFLSFSMEFLAKSPEHRQELIERPERI
PAACEELLRRFSLVADGRILTSDYEFHGVQLKKGDQILLPQMLSGLDERENACPMHVDFSRQKVSHTTFG
HGSHLCLGQHLARREIIVTLKEWLTRIPDFSIAPGAQIQHKSGIVSGVQALPLVWDPATTKAV

CYP101A1 (F87W,Y96F,V247L) engineered    SEQ ID NO:56
mTTETIQSNANLAPLPPHVPEHLVFDFDMYNPSNLSAGVQEAWAVLQESNVPDLVWTRCNGGHWIATR
GQLIREAYEDYRHFSSECPWIPREAGEAFDFIPTSMDPPEQRQFRALANQVVGMPVVDKLENRIQELACS
LIESLRPQGQCNFTEDYAEPFPIRIFMLLAGLPEEDIPHLKYLTDQMTRPDGSMTFAEAKEALYDYLIPIIEQ
RRQKPGTDAISIVANGQVNGRPITSDEAKRMCGLLLLGGLDTVVNFLSFSMEFLAKSPEHRQELIERPERI
PAACEELLRRFSLVADGRILTSDYEFHGVQLKKGDQILLPQMLSGLDERENACPMHVDFSRQKVSHTTFG
HGSHLCLGQHLARREIIVTLKEWLTRIPDFSIAPGAQIQHKSGIVSGVQALPLVWDPATTKAV

CYP106A2 (from Bacillus megaterium) SEQ ID NO:57
mKEVIAVKEITRFKTRTEEFSPYAWCKRMLENDPVSYHEGTDTWNVFKYEDVKRVLSDYKHFSSVRKRTT
ISVGTDSEEGSVPEKIQITESDPPDHRKRRSLLAAAFTPRSLQNWEPRIQEIADELIGQMDGGTEIDIVASLA
SPLPIIVMADLMGVPSKDRLLFKKWVDTLFLPFDREKQEEVDKLKQVAAKEYYQYLYPIVVQKRLNPADDII
SDLLKSEVDGEMFTDDEVVRTTMLILGAGVETTSHLLANSFYSLLYDDKEVYQELHENLDLVPQAVEEML
RFRFNLIKLDRTVKEDNDLLGVELKEGDSVVVWMSAANMDEEMFEDPFTLNIHRPNNKKHLTFGNGPHF
CLGAPLARLEAKIALTAFLKKFKHIEAVPSFQLEENLTDSATGQTLTSLPLKASRM

CYP152A1 (from Bacillus subtilis)    SEQ ID NO:58
mNEQIPHDKSLDNSLTLLKEGYLFIKNRTERYNSDLFQARLLGKNFICMTGAEAAKVFYDTDRFQRQNALP
KRVQKSLFGVNAIQGMDGSAHIHRKMLFLSLMTPPHQKRLAELMTEEWKAAVTRWEKADEVVLFEEAKEI
LCRVACYWAGVPLKETEVKERADDFIDMVDAFGAVGPRHWKGRRARPRAEEWIEVMIEDARAGLLKTTS
GTALHEMAFHTQEDGSQLDSRMAAIELINVLRPIVAISYFLVFSALALHEHPKYKEWLRSGNSREREMFVQ
EVRRYYPFGPFLGALVKKDFVWNNCEFKKGTSVLLDLYGTNHDPRLWDHPDEFRPERFAEREENLFDMI
PQGGGHAEKGHRCPGEGITIEVMKASLDFLVHQIEYDVPEQSLHYSLARMPSLPESGFVMSGIRRKS

P450cin (from Citrobacter brakii)    SEQ ID NO:59
mTATVASTSLFTTADHYHTPLGPDGTPHAFFEALRDEAETTPIGWSEAYGGHWVVAGYKEIQAVIQNTKA
FSNKGVTFPRYETGEFELMMAGQDDPVHKKYRQLVAKPFSPEATDLFTEQLRQSTNDLIDARIELGEGDA
ATWLANEIPARLTAILLGLPPEDGDTYRRWVWAITHVENPEEGAEIFAELVAHARTLIAERRTNPGNDIMSR
VIMSKIDGESLSEDDLIGFFTILLLGGIDNTARFLSSVFWRLAWDIELRRRLIAHPELIPNAVDELLRFYGPAM
VGRLVTQEVTVGDITMKPGQTAMLWFPIASRDRSAFDSPDNIVIERTPNRHLSLGHGIHRCLGAHLIRVEA
RVAITEFLKRIPEFSLDPNKECEWLMGQVAGMLHVPIIFPKGKRLSE

P450terp (from Pseudomonas)    SEQ ID NO:60
mDARATIPEHIARTVILPQGYADDEVIYPAFKWLRDEQPLAMAHIEGYDPMWIATKHADVMQIGKQPGLFS
NAEGSEILYDQNNEAFMRSISGGCPHVIDSLTSMDPPTHTAYRGLTLNWFQPASIRKLEENIRRIAQASVQ
RLLDFDGECDFMTDCALYYPLHVVMTALGVPEDDEPLMLKLTQDFFGVHEPDEQAVAAPRQSADEAARR
FHETIATFYDYFNGFTVDRRSCPKDDVMSLLANSKLDGNYIDDKYINAYYVAIATAGHDTTSSSSGGAIIGL
SRNPEQLALAKSDPALIPRLVDEAVRWTAPVKSFMRTALADTEVRGQNIKRGDRIMLSYPSANRDEEVFS
NPDEFDITRFPNRHLGFGWGAHMCLGQHLAKLEMKIFFEELLPKLKSVELSGPPRLVATNFVGGPKNVPI
RFTKA

FIG. 17-18

P450eryF (from Saccharopolyspora erythraeae)        SEQ ID NO:61
mTTVPDLESDSFHVDWYRTYAELRETAPVTPVRFLGQDAWLVTGYDEAKAALSDLRLSSDPKKKYPGVE
VEFPAYLGFPEDVRNYFATNMGTSDPPTHTRLRKLVSQEFTVRRVEAMRPRVEQITAELLDEVGDSGVV
DIVDRFAHPLPIKVICELLGVDEKYRGEFGRWSSEILVMDPERAEQRGQAAREVVNFILDLV
ERRRTEPGDD LLSALIRVQD DDDGRLSADE LTSIALVLLLAGFEASVSLI GIGTYLLLTH
PDQLALVRRDPSALPNAVEEILRYIAPPETTTRFAAEEVEIGGVAIPQYSTVLVANGAANRDPKQFPDPHR
FDVTRDTRGHLSFGQGIHFCMGRPLAKLEGEVALRALFGRFPALSLGIDADDVVWRRSLLLRGIDHLPVR
LDG

Human CYP1A2 (from Homo sapiens) SEQ ID NO:62
mALSQSVPFSATELLLASAIFCLVFWVLKGLRPRVPKGLKSPPEPWGWPLLGHVLTLGKNPHLALSRMSQ
RYGDVLQIRIGSTPVLVLSRLDTIRQALVRQGDDFKGRPDLYTSTLITDGQSLTFSTDSGPVWAARRRLAQ
NALNTFSIASDPASSSSCYLEEHVSKEAKALISRLQELMAGPGHFDPYNQVVVSVANVIGAMCFGQHFPE
SSDEMLSLVKNTHEFVETASSGNPLDFFPILRYLPNPALQRFKAFNQRFLWFLQKTVQEHYQDFDKNSVR
DITGALFKHSKKGPRASGNLIPQEKIVNLVNDIFGAGFDTVTTAISWSLMYLVTKPEIQRKIQKELDTVIGRE
RRPRLSDRPQLPYLEAFILETFRHSSFLPFTIPHSTTRDTTLNGFYIPKKCCVFVNQWQVNHDPELWEDPS
EFRPERFLTADGTAINKPLSEKMMLFGMGKRRCIGEVLAKWEIFLFLAILLQQLEFSVPPGVKVDLTPIYGL
TMKHARCEHVQARLRFSIN

Human CYP2C8 (from Homo sapiens) SEQ ID NO:63
mEPFVVLVLCLSFMLLFSLWRQSCRRRKLPPGPTPLPIIGNMLQIDVKDICKSFTNFSKVYGPVFTVYFGN
PIVVFHGYEAVKEALIDNGEEFSGRGNSPISQRITKGLGIISSNGKRWKEIRRFSLTTLRNFGMGKRSIEDR
VQEEAHCLVEELRKTKASPCDPTFILGCAPCNVICSVVFQKRFDYKDQNFLTLMKRFNENFRILNSPWIQV
CNNFPLLIDCFPGTHNKVLKNVALTRSYIREKVKEHQASLDVNNPRDFIDCFLIKMEQEKDNQKSEFNIENL
VGTVADLFVAGTETTSTTLRYGLLLLLLKHPEVTAKVQEEIDHVIGRHRSPCMQDRSHMPYTDAVVHEIQRY
SDLVPTGVPHAVTTDTKFRNYLIPKGTTIMALLTSVLHDDKEFPNPNIFDPGHFLDKNGNFKKSDYFMPFS
AGKRICAGEGLARMELFLFLTTILQNFNLKSVDDLKNLNTTAVTKGIVSLPPSYQICFIPV

Human CYP2C9 (from Homo sapiens) SEQ ID NO:64
mDSLVVLVLCLSCLLLLSLWRQSSGRGKLPPGPTPLPVIGNILQIGIKDISKSLTNLSKVYGPVFTLYFGLKPI
VVLHGYEAVKEALIDLGEEFSGRGIFPLAERANRGFGIVFSNGKKWKEIRRFSLMTLRNFGMGKRSIEDRV
QEEARCLVEELRKTKASPCDPTFILGCAPCNVICSIIFHKRFDYKDQQFLNLMEKLNENIKILSSPWIQICNN
FSPIIDYFPGTHNKLLKNVAFMKSYILEKVKEHQESMDMNNPQDFIDCFLMKMEKEKHNQPSEFTIESLEN
TAVDLFGAGTETTSTTLRYALLLLLLKHPEVTAKVQEEIERVIGRNRSPCMQDRSHMPYTDAVVHEVQRYID
LLPTSLPHAVTCDIKFRNYLIPKGTTILISLTSVLHDNKEFPNPEMFDPHHFLDEGGNFKKSKYFMPFSAGK
RICVGEALAGMELFLFLTSILQNFNLKSLVDPKNLDTTPVVNGFASVPPFYQLCFIPV

Human CYP2C19 (from Homo sapiens)        SEQ ID NO:65
mDPFVVLVLCLSCLLLLSIWRQSSGRGKLPPGPTPLPVIGNILQIDIKDVSKSLTNLSKIYGPVFTLYFGLER
MVVLHGYEVVKEALIDLGEEFSGRGHFPLAERANRGFGIVFSNGKRWKEIRRFSLMTLRNFGMGKRSIED
RVQEEARCLVEELRKTKASPCDPTFILGCAPCNVICSIIFQKRFDYKDQQFLNLMEKLNENIRIVSTPWIQIC
NNFPTIIDYFPGTHNKLLKNLAFMESDILEKVKEHQESMDINNPRDFIDCFLIKMEKEKQNQQSEFTIENLVI
TAADLLGAGTETTSTTLRYALLLLLLKHPEVTAKVQEEIERVIGRNRSPCMQDRGHMPYTDAVVHEVQRYID
LIPTSLPHAVTCDVKFRNYLIPKGTTILTSLTSVLHDNKEFPNPEMFDPRHFLDEGGNFKKSNYFMPFSAG
KRICVGEGLARMELFLFLTFILQNFNLKSLIDPKDLDTTPVVNGFASVPPFYQLCFIPV

Human CYP2D6 (from Homo sapiens) SEQ ID NO:66
mGLEALVPLAVIVAIFLLLVDLMHRRQRWAARYPPGPLPLPGLGNLLHVDFQNTPYCFDQLRRRFGDVFS
LQLAWTPVVVLNGLAAVREALVTHGEDTADRPPVPITQILGFGPRSQGRPFRPNGLLDKAVSNVIASLTCG
RRFEYDDPRFLRLLDLAQEGLKEESGFLREVLNAVPVLLHIPALAGKVLRFQKAFLTQLDELLTEHRMTWD
PAQPPRDLTEAFLAEMEKAKGNPESSFNDENLCIVVADLFSAGMVTTSTTLAWGLLLMILHPDVQRRVQQ
EIDDVIGQVRRPEMGDQAHMPYTTAVIHEVQRFGDIVPLGVTHMTSRDIEVQGFRIPKGTTLITNLSSVLKD
EAVWEKPFRFHPEHFLDAQGHFVKPEAFLPFSAGRRACLGEPLARMELFLFFTSLLQHFSFSVPTGQPRP
SHHGVFAFLVTPSPYELCAVPR

FIG. 17-19

Human CYP2E1 (from Homo sapiens) SEQ ID NO:67
mSALGVTVALLVWAAFLLLVSMWRQVHSSWNLPPGPFPLPIIGNLFQLELKNIPKSFTRLAQRFGPVFTLY
VGSQRMVVMHGYKAVKEALLDYKDEFSGRGDLPAFHAHRDRGIIFNNGPTWKDIRRFSLTTLRNYGMGK
QGNESRIQREAHFLLEALRKTQGQPFDPTFLIGCAPCNVIADILFRKHFDYNDEKFLRLMYLFNENFHLLST
PWLQLYNNFPSFLHYLPGSHRKVIKNVAEVKEYVSERVKEHHQSLDPNCPRDLTDCLLVEMEKEKHSAE
RLYTMDGITVTVADLFFAGTETTSTTLRYGLLILMKYPEIEEKLHEEIDRVIGPSRIPAIKDRQEMPYMDAVV
HEIQRFITLVPSNLPHEATRDTIFRGYLIPKGTVVVPTLDSVLYDNQEFPDPEKFKPEHFLNENGKFKYSDY
FKPFSTGKRVCAGEGLARMELFLLLCAILQHFNLKPLVDPKDIDLSPIHIGFGCIPPRYKLCVIPRS

Human CYP2F1 (from Homo sapiens) SEQ ID NO:68
mDSISTAILLLLLALVCLLLTLSSRDKGKLPPGPRPLSILGNLLLLCSQDMLTSLTKLSKEYGSMYTVHLGPR
RVVVLSGYQAVKEALVDQGEEFSGRGDYPAFFNFTKGNGIAFSSGDRWKVLRQFSIQILRNFGMGKRSIE
ERILEEGSFLLAELRKTEGEPFDPTFVLSRSVSNIICSVLFGSRFDYDDERLLTIIRLINDNFQIMSSPWGELY
DIFPSLLDWVPGPHQRIFQNFKCLRDLIAHSVHDHQASLDPRSPRDFIQCFLTKMAEEKEDPLSHFHMDTL
LMTTHNLLFGGTKTVSTTLHHAFLALMKYPKVQARVQEEIDLVVGRARLPALKDRAAMPYTDAVIHEVQRF
ADIIPMNLPHRVTRDTAFRGFLIPKGTDVITLLNTVHYDPSQFLTPQEFNPEHFLDANQSFKKSPAFMPFSA
GRRLCLGESLARMELFLYLTAILQSFSLQPLGAPEDIDLTPLSSGLGNLPRPFQLCLRPR

Human CYP3A4 (from Homo sapiens) SEQ ID NO:69
mALIPDLAMETWLLLAVSLVLLYLYGTHSHGLFKKLGIPGPTPLPFLGNILSYHKGFCMFDMECHKKYGKV
WGFYDGQQPVLAITDPDMIKTVLVKECYSVFTNRRPFGPVGFMKSAISIAEDEEWKRLRSLLSPTFTSGKL
KEMVPIIAQYGDVLVRNLRREAETGKPVTLKDVFGAYSMDVITSTSFGVNIDSLNNPQDPFVENTKKLLRF
DFLDPFFLSITVFPFLIPILEVLNICVFPREVTNFLRKSVKRMKESRLEDTQKHRVDFLQLMIDSQNSKETES
HKALSDLELVAQSIIFIFAGYETTSSVLSFIMYELATHPDVQQKLQEEIDAVLPNKAPPTYDTVLQMEYLDMV
VNETLRLFPIAMRLERVCKKDVEINGMFIPKGVVVMIPSYALHRDPKYWTEPEKFLPERFSKKNKDNIDPYI
YTPFGSGPRNCIGMRFALMNMKLALIRVLQNFSFKPCKETQIPLKLSLGGLLQPEKPVVLKVESRDGTVSG
A

CYP153A6 (from Mycobacterium sp. HXN1500)       SEQ ID NO:70
mTEMTVAASDATNAAYGMALEDIDVSNPVLFRDNTWHPYFKRLREEDPVHYCKSSMFGPYWSVTKYRDI
MAVETNPKVFSSEAKSGGITIMDDNAAASLPMFIAMDPPKHDVQRKTVSPIVAPENLATMESVIRQRTADL
LDGLPINEEFDWVHRVSIELTTKMLATLFDFPWDDRAKLTRWSDVTTALPGGGIIDSEEQRMAELMECAT
YFTELWNQRVNAEPKNDLISMMAHSESTRHMAPEEYLGNIVLLIVGGNDTTRNSMTGGVLALNEFPDEYR
KLSANPALISSMVSEIIRWQTPLSHMRRTALEDIEFGGKHIRQGDKVVMWYVSGNRDPEAIDNPDTFIIDRA
KPRQHLSFGFGIHRCVGNRLAELQLNILWEEILKRWPDPLQIQVLQEPTRVLSPFVKGYESLPVRINA

CYP153A7 (from Sphingopyxis macrogoltabida)        SEQ ID NO:71
mEHTGQSAAATMPLDSIDVSIPELFYNDSVGEYFKRLRKDDPVHYCADSAFGPYWSITKYNDIMHVDTNH
DIFSSDAGYGGIIIDDGIQKGGDGGLDLPNFIAMDRPRHDEQRKAVSPIVAPANLAALEGTIRERVSKTLDG
LPVGEEFDWVDRVSIEITTQMLATLFDFPFEERRKLTRWSDVTTAAPGGGVVESWDQRKTELLECAAYF
QVLWNERVNKDPGNDLISMLAHSPATRNMTPEEYLGNVLLLIVGGNDTTRNSMTGGVLALHKNPDQFAK
LKANPALVETMVPEIIRWQTPLAHMRRTAIADSELGGKTIRKGDKVVMWYYSGNRDDEVIDRPEEFIIDRP
RPRQHLSFGFGIHRCVGNRLAEMQLRILWEEILTRFSRIEVMAEPERVRSNFVRGYAKMMVRVHA

CYP153A8 (from Sphingopyxis macrogoltabida)        SEQ ID NO:72
mDTDMVEPNIREKVAFIPIDEIDVARPSLFQKDTVGLFFERLRREEPVHYCRESYVGPYWSITKFDDIMAV
DTNHKVFSSEAKLGGIAIEDMHSAKSALELEMFIAMDPPKHNQQRKAVTGAVAPSNLLLLEPTIRERACQIL
DDLPVGEDIDWVDKVAVELTTMTLATLFDFPWEERRKTRWSDVTTAAPETGIVASYEARRAELIECAMYF
KGLWEQRINAEPKNDLISMMAHSPATRDMPFLEFLGNLLLLIVGGNDTTRNSISGGVLALNQNPDAYLKLN
NDPGLITSMVPEIIRWQTPLTHMRRTALQDWEIGGKKIRKGDKVVMWYLSGNRDETVIDRADEFIIDRKNP
RHHLSFGYGIHRCMGNRLAELQLRIIWEEIHKRFAKIEVTGEPERLFSNLVRGITKLPVRLHAR

CYP153A11 (from Sphingopyxis macrogoltabida)        SEQ ID NO:73
mATRSMQSGPDREEPDRPIAEIPLAEIDVSRPSLFQSDKVGAFFERLRREDPVHYCSESAFGPYWSITRY
NDIMAVDTNHKLFSSEAKLGGIAIQDMHNDATNLELEMFIAMDQPKHDAQRKAVTPAVAPSNLLLLEPVIR
ERAGAILDSLPVGEEIDWVKSVSVELTTMTLATLFDFPWDERAKLTRWSDVTTAIPGSGIVESNEQRRQEL
IECAMYFKGLWDQRIDRSEGSDLITMMANSPATREMPFLEFLGNLLLLIVGGNDTTRNSISGGVIALNQNP
DQYEKLRQHPSLIGSMVPEIIRWQTPLTHMRRTALADSEIGGKRIAKGDKVVMWYLSGNRDETVIERPEEF
IIDRKNPRQHLSFGYGIHRCMGNRLAELQLRIIWEEIHKRFRLVEMVGEPERLLSNLVRGITRLPVKLHAH

FIG. 17-20

CYP153D2 (from Sphingopyxis macrogoltabida)　　SEQ ID NO:74
mATVIRETPADLHPLDLSRADLWREDQWQEPMRQLRAESPIYYCEDSKFGPYWSVTTYKPIQHIEALPKIF
SSSWEYGGITVAGDGIEHLKEGEIPMPMFIAMDPPQHTAQRRTVAPAFGPSEIERMRADTQARTAALIDTL
PVGEAFDWVERLSIELTTDMLAILFDFPWENRHNLTRWSDALGDIESFNTLEERQQRLATAFEMGAAFKE
LWDHKAKNPGKHDLISIMLQSDAMNHMSHEEFMGNLILLIVGGNDTTRNSMSAYAYGLHCFPEERAKLEA
NHDPDLAVNAMHEIIRWQTPLAHMRRTALEDTELFGHQIRARDKIALWYASANRDESIFPDGDRIIVDREN
ARRHLAFGYGIHRCVGARVAELQLTTLISEMQKRRLRVNVLAEPERVNASFVHVSPHAGRTRALLTAVTA
GPISAR

CYP153D3 (from Sphingopyxis macrogoltabida)　　SEQ ID NO:75
mASTATLVRTASPIAPIDVSLPELYAEDRWQEPFRTLRAQAPIQYVPDSKFGPYWSVTTYKPIVYIEALPKL
FSSSWQYGGISIAFDSDKLLEHEVRQPMFIAMDPPQHTAQRRTVAXSFGPSEVAAMKAEVQLRTGALLDS
LPVGDPFDWVQKVSIELTTGMLARLFDFPWEERHNLTHWSDIGGDVELIRSPEGLVERNTKLLQMGMAF
AALWQEKAQNPGKDLISVMLKSDAMNHMSNEEFIGNLVLLIVGGNDTTRNSMSSYAYGLAQFPEERAKLE
ANPALIPNAVQELIRWQTPLAHMRRTVEEDTEIXGQXXKKGDKVVLWYLSANRDETVFKDADRIIVGRENA
RRRHLSFGYGIHRCVGARVAELQLVTLLEEMAKRRLRANVLAEPVRVPACFVHGYKSLQVELSHY

CYP153-AlkBurk (from Alcanivorax borkumensis)　　SEQ ID NO:76
mSTSSSTSNDIQAKVINATSKVVPMHLQIKALKNLMKVKRKTIGTSRPQVHFVETDLPDVNDLAIEDIDTSN
PFLYRQGKANAYFKRLRDEAPVHYQKNSAFGPFWSVTRYEDIVFVDKSHDLFSAEPQIILGDPPEGLSVE
MFIAMDPPKHDVQRRAVQGVVAPKNLKEMEGLIRKRTGDVLDSLPLDTPFNWVPVVSKELTGRMLASLL
DFPYDEREKLVGWSDRLSGASSATGGEFTNEDVFFDDAADMAWAFSKLWRDKEARQKAGEEPGFDLIS
MLQSNEDTKDLINRPLEFIGNLALLIVGGNDTTRNSMSGGVLALNQFPEQFEKLKANPKLIPNMVSEIIRWQ
TPLAYMRRVAKQDVELNGETIKKGDRVLMWYASGNQDERKFENPEQFIIDRKDTRNHVSFGYGVHRCM
GNRLAELQLRILWEELLPRFENIEVIGEPERVQSNFVRGYSKMMVKLTAKK

CYP153-EB104 (from Acinetobacter sp. EB104)　　SEQ ID NO:77
mNSVAEIFEKITQTVTSTAADVATTVTDKVKSNEQFQTGKQFLHGQVTRFVPLHTQVRGIQWMQKAKFRV
FNVQEFPAFIEQPIPEVATLALAEIDVSNPFLYKQKKWQSYFKRLRDEAPVHYQANSPFGAFWSVTRYDDI
VYVDKNHEIFSAEPVIAIGNTPPGLDAEMFIAMDPPKHDVQRQAVQDVVAPKNLKELEGLIRLRVQGVLDQ
LPTDQPFDWVQNVSIELTARMLATLFDFPYEKRHKLVEWSDLMAGTAEATGGTVTNLDEIFDAAVDAAKH
FAELWHRKAAQKSAGAEMGYDLISLMQSNEATKDLIYRPMEFMGNLVLLIVGGNDTTRNSMTGGVYALN
LFPNEFVKLKNNPSLIPNMVSEIIRWQTPLAYMRRIAKQDVELNGQTIKKGDKVVMWYVSGNRDERVIERP
DELIIDRKGARNHLSFGFGVHRCMGNRLAEMQLRILWEELLQRFENIEVLGEPEIVQSNFVRGYAKMMVK
LTAKA

CYP153-OC4 (from Acinetobacter sp. OC4)　　SEQ ID NO:78
mNSVAEIFEKITQTVTSTAADVATTVTDKVKSNEQFQTGKQFLHGQVTRFVPLHTQVRGIQWMQKAKFRV
FNVQEFPAFIEQPIPEVATLALAEIDVSNPFLYKQKKWQSYFKRLRDEAPVHYQANSPFGAFWSVTRYDDI
VYVDKNHEIFSAEPVIAIGNTPPGLGAEMFIAMDPPKHDVQRQAVQDVVAPKNLKELEGLIRLRVQEVLDQ
LPTDQPFDWVQNVSIELTARMLATLFDFPYEKRHKLVEWSDLMAGTAEATGGTVTNLDEIFDAAVDAAKH
FAELWHRKAAQKSAGAEMGYDLISLMQSNEATKDLIYRPMEFMGNLVLLIVGGNDTTRNSMTGGVYALN
LFPNEFVKLKNNPSLIPNMVSEIIRWQTPLAYMRRIAKQDVELNGQTIKKGDKVVMWYVSGNRDERVIERP
DELIIDRKGARNHLSFGFGVHRCMGNRLAEMQLRILWEELLQRFENIEVLGEPEIVQSNFVRGYAKMMVK
LTAKA

CYP71AV1(from Artemisia annua)　　SEQ ID NO:79
mALSLTTSIALATILLFVYKFATRSKSTKKSLPEPWRLPIIGHMHHLIGTTPHRGVRDLARKYGSLMHQLG
EVPTIVVSSPKWAKEILTTYDITFANRPETLTGEIVLYHNTDVVLAPYGEYWRQLRKICTLELLSVKKVKSFQ
SLREEECWNLVQEIKASGSGRPVNLSENIFKLIATILSRAAFGKGIKDQKELTEIVKEILRQTGGFDVADIFP
SKKFLHHLSGKRARLTSLRKKIDNLIDNLVAEHTVNTSSKTNETLLDVLLRLKDSAEFPLTSDNIKAIILDMFG
AGTDTSSSTIEWAISELIKCPKAMEKVQAELRKALNGKEKIHEEDIQELSYLNMVIKETLRLHPPLPLVLPRE
CRQPVNLAGYNIPNKTKLIVNVFAINRDPEYWKDAEAFIPERFENSSATVMGAEYEYLPFGAGRRMCPGA
ALGLANVQLPLANILYHFNWKLPNGVSYDQIDMTESSGATMQRKTELLLVPSF

FIG. 17-21

CYP71AV8(from Cichorium intybus)   SEQ ID NO:80
mEISIPTTLGLAVIIFIIFKLLTRTTSKKNLLPEPWRLPIIGHMHHLIGTMPHRGVMELARKHGSLMHLQLGEV
STIVVSSPRWAKEVLTTYDITFANRPETLTGEIVAYHNTDIVLAPYGEYWRQLRKLCTLELLSNKKVKSFQS
LREEECWNLVKDIRSTGQGSPINLSENIFKMIATILSRAAFGKGIKDQMKFTELVKEILRLTGGFDVADIFPS
KKLLHHLSGKRAKLTNIHNKLDNLINNIIAEHPGNRTSSSQETLLDVLLRLKESAEFPLTADNVKAVILDMFG
AGTDTSSATIEWAISELIRCPRAMEKVQTELRQALNGKERIQEEDLQELNYLKLVIKETLRLHPPLPLVMPR
ECREPCVLGGYDIPSKTKLIVNVFAINRDPEYWKDAETFMPERFENSPITVMGSEYEYLPFGAGRRMCPG
AALGLANVELPLAHILYYFNWKLPNGKTFEDLDMTESFGATVQRKTELLLVPTDFQTLTAST

CYP725A1 (from Taxus cuspidata)   SEQ ID NO:81
mDSFIFLRSIGTKFGQLESSPAILSLTLAPILAIILLLLFRYNHRSSVKLPPGKLGFPLIGETIQLLRTLRSETPQ
KFFDDRLKKFGPVYMTSLIGHPTVVLCGPAGNKLVLSNEDKLVEMEGPKSFMKLIGEDSIVAKRGEDHRIL
RTALARFLGAQALQNYLGRMSSEIGHHFNEKWKGKDEVKVLPLVRGLIFSIASTLFFDVNDGHQQKQLHH
LLETILVGSLSVPLDFPGTRYRKGLQARLKLDEILSSLIKRRRRDLRSGIASDDQDLLSVLLTFRDEKGNSLT
DQGILDNFSAMFHASYDTTVAPMALIFKLLYSNPEYHEKVFQEQLEIIGNKKEGEEISWKDLKSMKYTWQA
VQESLRMYPPVFGIFRKAITDIHYDGYTIPKGWRVLCSPYTTHLREEYFPEPEEFRPSRFEDEGRHVTPYT
YVPFGGGLRTCPGWEFSKIEILLFVHHFVKNFSSYIPVDPNEKVLSDPLPPLPANGFSIKLFPRS

CYP725A2 (from Taxus cuspidata)   SEQ ID NO:82
mDALKQLEVSPSILFVTLAVMAGIILFFRSKRHSSVKLPPGNLGFPLVGETLQFVRSLGSSTPQQFIEERMS
KFGDVFKTSIIGHPTVVLCGPAGNRLVLSNENKLVQMSWPSSMMKLIGEDCLGGKTGEQHRIVRAALTRF
LGPQALQNHFAKMSSGIQRHINEKWKGKDEATVLPLVKDLVFSVASRLFFGITEEHLQEQLHNLLEVILVG
SFSVPLNIPGFSYHKAIQARATLADIMTHLIEKRRNELRAGTASENQDLLSVLLTFTDERGNSLADKEILDNF
SMLLHGSYDSTNSPLTMLIKVLASHPESYEKVAQEQFGILSTKMEGEEIAWKDLKEMKYSWQVVQETLRM
YPPIFGTFRKAITDIHYNGYTIPKGWKLLWTTYSTQTKEEYFKDADQFKPSRFEEEGKHVTPYTYLPFGGG
MRVCPGWEFAKMETLLFLHHFVKAFSGLKAIDPNEKLSGKPLPPLPVNGLPIKLYSRS

CYPX (from Taxus cuspidata) SEQ ID NO:83
mDALSLVNSTVAKFNEVTQLQASPAILSTALTAIAGIIVLLVITSKRRSSLKLPPGKLGLPFIGETLEFVKALRS
DTLRQFVEEREGKFGRVFKTSLLGKPTVILCGPAGNRLVLSNEEKLLHVSWSAQIARILGLNSVAVKRGDD
HRVLRVALAGFLGSAGLQLYIGKMSALIRNHINEKWKGKDEVNVLSLVRDLVMDNSAILFFNIYDKERKQQ
LHEILKIILASHFGIPLNIPGFLYRKALKGSLKRKKILSALLEKRKDELRSRLASSNQDLLSVLLSFRDERGKP
LSDEAVLDNCFAMLDASYDTTTSQMTLILKMLSSNPECFEKVVQEQLEIASNKKEGEEITMKDIKAMKYTW
QVLQESLRMLSPVFGTLRKTMNDINHDGYTIPKGWQVVWTTYSTHQKDIYFKQPDKFMPSRFEEEDGHL
DAYTFVPFGGGRRTCPGWEYAKVEILLFLHHFVKAFSGYTPTDPHERICGYPVPLVPVKGFPIKLIARS

CYPX (from Taxus wallichiana var. chinensis)       SEQ ID NO:84
mDALYKSTVAKFNEVTQLDCSTESFSIALSSIAGILLLLLLFRSKRHSSLKLPPGKLGIPFIGESFIFLRALRSN
SLEQFFDERVKKFGLVFKTSLIGHPTVVLCGPAGNRLILSNEEKLVQMSWPAQFMKLMGENSVATRRGE
DHIVMRSALAGFFGPGALQSYIGKMNTEIQNHINEKWKGKDEVNVLPLVRELVFNISAILFFNIYDKQEQDR
LHKLLETILVGSFALPIDLPGFGFHRALQGRATLNKIMLSLIKKRKEDLQSGSATATQDLLSVLLTFRDDKGT
PLTNDEILDNFSSLLHASYDTTTSPMALIFKLLSSNPECYQKVVQEQLEILSNKEEGEEITWKDLKAMKYTW
QVAQETLRMFPPVFGTFRKAITDIQYDGYTIPKGWKLLWTTYSTHPKDLYFSEPEKFMPSRFDQEGKHVA
PYTFLPFGGGQRSCVGWEFSKMEILLFVHHFVKTFSSYTPVDPDEKISGDPLPPLPSKGFSIKLFPETIVN

CYP71D20-NtEAH (from Nicotiana tabacum) SEQ ID NO:85
mQFFSLVSIFLFLSFLFLLRKWKNSNSQSKKLPPGPWKIPILGSMLHMIGGEPHHVLRDLAKKYGPLMHLQ
LGEISAVVVTSRDMAKEVLKTHDVVFASRPKIVAMDIICYNQSDIAFSPYGDHWRQMRKICVMELLNAKNV
RSFSSIRRDEVVRLIDSIRSDSSSGELVNFTQRIIWFASSMTCRSAFGQVLKGQDIFAKKIREVIGLAEGFDV
VDIFPTYKFLHVLSGMKRKLLNAHLKVDAIVEDVINEHKKNLAAGKSNGALGGEDLIDVLLRLMNDTSLQFP
ITNDNIKAVIVDMFAAGTETSSTTTVWAMAEMMKNPSVFTKAQAEVREAFRDKVSFDENDVEELKYLKLVI
KETLRLHPPSPLLVPRECREDTDINGYTIPAKTKVMVNVWALGRDPKYWDDAESFKPERFEQCSVDFFG
NNFEFLPFGGGRRICPGMSFGLANLYLPLAQLLYHFDWKLPTGIMPRDLDLTELSGITIARKGGLYLNATP
YQPSRE

FIG. 17-22

CYPX-a (from Cichorium intybus)      SEQ ID NO:86
mELSLTTSIALATIVLILYKLATRPKSNKKRLPEASRLPIIGHMHHLIGTMPHRGVMELARKHGSLMHLQLGE
VSTIVVSSPKWAKEILTTYDITFANRPETLTGEIIAYHNTDIVLAPYGEYWRQLRKLCTLELLSVKKVKSFQSI
REEECWNLVKEVKESGSGKPISLSESIFKMIATILSRAAFGKGIKDQREFTEIVKEILRQTGGFDVADIFPSK
KFLHHLSGKRARLTSIHKKLDTLINNIVAEHHVSTSSKANETLLDVLLRLKDSAEFPLTADNVKAIILDMFGA
GTDTSSATVEWAISELIRCPRAMEKVQAELRQALNGKEQIHEEDIQDLPYLNLVIRETLRLHPPLPLVMPRE
CREPVNLAGYEIANKTKLIVNVFAINRDPEYWKDAEAFIPERFENNPNNIMGADYEYLPFGAGRRMCPGA
ALGLANVQLPLANILYHFNWKLPNGASHDQLDMTESFGATVQRKTELILVPSF

CYPX-b (from Cichorium intybus)      SEQ ID NO:87
mEPLTIVSLVVASLFLFAFWALSPKTSKNLPPGPPKLPIIGNIHQLKSPTPHRVLRNLARKYGPIMHLQLGQ
VSTVVVSTPRLAREIMKTNDISFADRPTTTTSQIFFYKAQDIGWAPYGEYWRQMKKICTLELLSAKKVRSF
SSIREEELSRISKVLESQAGTPINFTEMTVEMVNNVICKATLGDSCKDQATLIEVLYDVLKTLSAFNLASYYP
GLQFLNVILGKKAKWLKMQKQLDDILEDVLKEHRSKGSNKSDQEDLVDVLLRVKDTGGLDFTVTDEHVKA
VVLDMLTAGTDTSSATLEWAMTELMRNPHMMKRAQDEVRSVVKGNTITETDLQSLHYLKLIVKETLRLHA
PTPLLVPRECRQDCNVDGYDIPAKTKILVNAWACGTDPDSWKDPESFIPERFENCPINYMGADFEFIPFGA
GRRICPGLTFGLSMVEYPLANFLYHFDWKLPNGLKPHELDITEITGISTSLKHQLKIVPMIPKSIAK

CYPX (from Xanthophyllomyces dendrorhous)      SEQ ID NO:88
SIAFFSLYLAPRRSSLYNLQGPDHTNYFTGNFLDILSARTGEEHAKYREKYGSTLRFAGIAGAPVLNSTDP
KVFNHVMKEAYDYPKPGMAARVLRIATGDGVVTAEGEAHKRHRRIMIPSLSAQAVKSMVPIFLEEGMELV
DKMMEDAAEKDMAVGESAGEKKATRLETEGVDVKDWVGRATLDVMALAGFDYKSDSLQNKTNELYVAF
VGLTDGFAPTLDSFKAIMWDFVPYFRTMKRRHEIPLTQGLAVSRRVGIELMEQKKQAVLGSASDQAVDKK
DVQGRDILSLLVRANIAANLPESQKLSDEEALAQISNLLFAGYETSSTVLTWMFHRLSEDKAVQDKLREEIC
QIDTDMPTLDELNALPYLEAFVKESLRLDPPSPYANRECLKDEDFIPLAEPVIGRDGSVINEVRITKGTMVV
LPLFNVNRSKFIYGEDAEEFRPERWLEDVTDSLNSIEAPYGHQASFISGPRACFGWRFAVAEMKAFLFVT
LRRVQFEPIISHPEYEHITLIISRP

CYP110C1 (from Nostoc sp. PCC 7120)      SEQ ID NO:89
mKYQIQRPNPLKTHPFLQKLQWIADPVEYMKKASLQHPDMFTAEVIGFGDTVVFVSHPQGIQTLFANDRK
KLVAVGEANRILYPLVGNNSMFLLEGVKHKQRRQLLMPSFHGERMREYGHLIRNITENLFSQLQQDVTFS
ALTAMREISMQVILQAVFGFYEGERCQQFKHLLPIFLSELFQSPLASSILFFPSLQKDLGNLTPWGRFVRQ
REKIDKLLYAEIAERRQEINSDRIDILSLLISARDETGDSMSDKELRDELITLMISGHETTGTAMAWSLYWILQ
TPEVFQRLIQELDSLGDSPDPMSIFRLPYLTAVCNETLRINPVAMLTLPRVVKEPIELLGNRLETSTTVVGCI
YLTHHREDLYPESKLFKPERFLKREFSQYEFMPFGGGVRGCIGQALAMFEMKIVLATVLSRYQLALADRK
PERPQRQGFTLTPTNGVKMLITGQHKRQNYSMAASTTFNA

CYP99A3 (from Oryza sativa Japonica)      SEQ ID NO:90
mMEINSEATVTLVSVVTLPILLALLTRKSSSKKRRPPGPWNLPLVGGLLHLLRSQPQVALRDLAGKYGPVM
FLRTGQVDTVVISSPAAAQEVLRDKDVTFASRPSLLVSEIFCYGNLDIGFAPYGAYWRMLRKLCTVELLST
KMVRQLAPIRDGETLALVRNIEAAAGGKKPFTLATLLISCTNTFTAKAAFGQACGGELQEQFLTALDEALKF
SNGFCFGDLFPSLRFIDAMTGLRSRLERLRLQLDTVFDKIVAQCESNPGDSLVNVLLRIKDQGELDFPFSS
THVKAIILDMFTGGTETTSSTTEWLMSELMRNPEVMAKVQAEVRGVFDNKSPQDHEGLLENLSYMKLVIK
ETLRLNPVLPLLLPHLCRETCEIGGYEIVEGTRVLINSWAMARSPEYWDDAEKFIPERFEDGTADFKGSRF
EYLPFGTGRRRCPGDIFAMATLELIVARLLYYFDWSLPDGMQPGDIDMELVVGATARRKNHLQLVASPYK
PISMQS

CYP71BL2 (from Helianthus annuus)  SEQ ID NO:91
mSLDFQVFLFSSLPLLLAILLLKLYFSSSKSHINLPPSPPKLPLIGNLHQLGSGTHRVLQSMAQTYGPLMLLH
FGTVPVVVASSVDAARDIMKTHDIIFSNRPFLNIANRLFYNSKDIAFAKYGEYWRQVKSISVLHLLSNKRVK
SYRQVREDEVAHMIKKIQGANESVVNLSELLISLTNNVISRVALGRTYEGMGVNYKNIPVRIGAILGRFSIGS
YIPWLAWVDRLTGLHREADQLAKEIDEFYEGVIEEHVNKKVVDVEGQDLVDILLELQRDNSTSFLLERYTV
KAIIMDVFGAGTDTIFASLEWAISELLRNPHTMKELQQEARKIGQGRLMIPENDIEKMPYLKAVLKEALRLH
VPAPLLVPRESTKEVKLLGYDIPAHTQVMINAWAIARDPSIWEEPEEFRPERFLNIRTDYKGFDFELIPFGA
GRRMCPGISFAETIIELALANLAYKFEFTLPSEDGLDMTESDGITVHRKFPILVIPTPCE

FIG. 17-23

CYP71AV8 (from Cichorium intybus) SEQ ID NO:92
mEISIPTTLGLAVIIFIIFKLLTRTTSKKNLLPEPWRLPIIGHMHHLIGTMPHRGVMELARKHGSLMHLQLGEV
STIVVSSPRWAKEVLTTYDITFANRPETLTGEIVAYHNTDIVLAPYGEYWRQLRKLCTLELLSNKKVKSFQS
LREEECWNLVKDIRSTGQGSPINLSENIFKMIATILSRAAFGKGIKDQMKFTELVKEILRLTGGFDVADIFPS
KKLLHHLSGKRAKLTNIHNKLDNLINNIIAEHPGNRTSSSQETLLDVLLRLKESAEFPLTADNVKAVILDMFG
AGTDTSSATIEWAISELIRCPRAMEKVQTELRQALNGKERIQEEDLQELNYLKLVIKETLRLHPPLPLVMPR
ECREPCVLGGYDIPSKTKLIVNVFAINRDPEYWKDAETFMPERFENSPITVMGSEYEYLPFGAGRRMCPG
AALGLANVELPLAHILYYFNWKLPNGKTFEDLDMTESFGATVQRKTELLLVPTDFQTLTAST

CYP109D1 (from Sorangium cellulosum) SEQ ID NO:93
mETETAPSPSPEQIDLSAPSVIADPYPAYRALRGRSPVLYARVPAGGAAGLGEPIRAYALLRHAEVLAALR
DPQTFSSNVTDKIRVLPRITLLHDDPPRHTHLRRLVSRSFTPRRIAELEPWIGRLAASLLEATGDGPSDLM
GAYAMPLPMMVIATLLGIPAERYVQFRSWSESVMSYSGIPAEERASRGKAMVDFFAAELEARRRAPSGD
LISALVEAEIDGARLDTPEAVGFCVGLLVAGNDTTTNLIGNMAHLLSERPELYRRAQQDRSLVGPIIEETLR
HSSPVQRLLRVTTRPVDVSGVMIPAGHLVDVVFGAANRDPAVFEEPDAFRLDRPPAEHLAFGQGTHFCIG
AALARMEARIALNALLDCYESITPGEAPPLRQTRAIMPLGFESLPLVLRRSRATA

CYP4C7 (from Diploptera punctata) SEQ ID NO:94
AVLLLTSLAIVVVYLCRRLNFWVKLRSVPGPPALPFLGNSLILRGTQEEFFRLLSKCATKYGNIFRLWVGQR
PFVFLYSAEAIQPILNSTVYIDKSYEYSFLFPWLGTGLLTSTGNKWHTRRKLLTQSFHSKVLEDFLEPIYQH
SLFLCNRLELELDKPHFKVTPYAKLCALDIICDTAMGSTINAQENSQSEYVTAVDSLSEIVQRRFITPWLKP
DFLFKMTKLGKKQEQCLKIVHNFTRKVINERKEDKLRQNNLEVEISQQNGIKKKHRLALLDLLLELSENGKV
LTDEDICEEVDTFMFAGHDTIASGVSWILYVLGHHLDSQEKIVEEFKNVMEEDNTEWPTMKHLNKLCYLE
RCIKEAMRLYPVVPLIARNLTQPIKIMDYMLPEGVTILINTYLLHRDSRFFPNPDIFEPDRFLTSNCEARNPF
AYVPFSAGPRNCIGQKFAMMELKIILSTVLQRFIVKSVDKEERLKLVGELVLLNRDGIRLTITART

CYP71BJ1 (from Diploptera punctata) SEQ ID NO:95
mLSSLKDFFVLLLPFFIGIAFIYKLWNFTSKKNLPPSPRRLPIIGNLHQLSKFPQRSLRTLSEKYGPVMLLHF
GSKPVLVISSAEAAKEVMKINDVSFADRPKWYAAGRVLYEFKDMTFSPYGEYWRQARSICVLQLLSNKRV
QSFKGIREEEIRAMLEKINQASNNSSIINGDEIFSTLTNDIIGRSAFGRKFSEEESGSKLRKVLQDLPPLLGS
FNVGDFIPWLSWVNYLNGFEKKLNQVSKDCDQYLEQVIDDTRKRDEENGANNNGGNHGNFVSVLLHLQ
KEDVKGFPSEKGFLKAIILDMIVGGTDTTHLLLHWVITELLKNKHVMTKLQKEVREIVGRKWEITDEDKEKM
KYLHAVIKEALRLHPSLPLLVPRVAREDINLMGYRVAKGTEVIINAWAIARDPSYWDEAEEFKPERFLSNNF
DFKGLNFEYIPFGSGRRSCPGSSFAIPIVEHTVAHLMHKFNIELPNGVSAEDFDPTDAVGLVSHDQNPL

CYP71D9 (from Glycine max) SEQ ID NO:96
mDLQLLYFTSIFSIFIFMFMTHKIVTKKSNSTPSLPPGPWKLPIIGNMHNLVGSPLPHHRLRDLSAKYGSLM
HLKLGEVSTIVVSSPEYAKEVMKTHDHIFASRPYVLAAEIMDYDFKGVAFTPYGDYWRQLRKIFALELLSSK
RVQSFQPIREEVLTSFIKRMATIEGSQVNVTKEVISTVFTITARTALGSKSRHHQKLISVVTEAAKISGGFDL
GDLYPSVKFLQHMSGLKPKLEKLHQQADQIMQNIINEHREAKSSATGDQGEEEVLLDVLLKKEFGLSDESI
KAVIWDIFGGGSDTSSATITWAMAEMIKNPRTMEKVQTEVRRVFDKEGRPNGSGTENLKYLKSVVSETLR
LHPPAPLLLPRECGQACEINGYHIPAKSRVIVNAWAIGRDPRLWTEAERFYPERFIERSIEYKSNSFEFIPF
GAGRRMCPGLTFGLSNVEYVLAMLMYHFDWKLPKGTKNEDLGMTEIFGITVARKDDLYLIPKTVHN

CYP71D12 (synthetic construct) SEQ ID NO:97
mEFYYFLYLAFLLFCFILSKTTKKFGQNSQYSNHDELPPGPPQIPILGNAHQLSGGHTHHILRDLAKKYGPL
MHLKIGEVSTIVASSPQIAEEIFRTHDILFADRPSNLESFKIVSYDFSDMVVSPYGNYWRQLRKISMMELLS
QKSVQSFRSIREEEVLNFIKSIGSKEGTRINLSKEISLLIYGITTRAAFGEKNKNTEEFIRLLDQLTKAVAEPNI
ADMFPSLKFLQLISTSKYKIEKIHKQFDVIVETILKGHKEKINKPLSQENGEKKEDLVDVLLNIQRRNDFEAPL
GDKNIKAIIFNIFSAGTETSSTTVDWAMCEMIKNPTVMKKAQEEVRKVFNEEGNVDETKLHQLKYLQAVIKE
TLRLHPPVPLLLPRECREQCKIKGYTIPSKSRVIVNAWAIGRDPNYWIEPEKFNPDRFLESKVDFKGNSFE
YLPFGGGRRICPGITFALANIELPLAQLLFHFDWQSNTEKLNMKESRGVTVRREDDLYLTPVNFSSSSPA

FIG. 17-24

CYP71E1 (from Sorghum bicolor)    SEQ ID NO:98
mATTATPQLLGGSVPQQWQTCLLVLLPVLLVSYYLLTSRSRNRSRSGKLGGAPRLPPGPAQLPILGNLHL
LGPLPHKNLRELARRYGPVMQLRLGTVPTVVVSSAEAAREVLKVHDVDCCSRPASPGPKRLSYDLKNVG
FAPYGEYWREMRKLFALELLSMRRVKAACYAREQEMDRLVADLDRAAASKASIVLNDHVFALTDGIIGTV
AFGNIYASKQFAHKERFQHVLDDAMDMMASFSAEDFFPNAAGRLADRLSGFLARRERIFNELDVFFEKVI
DQHMDPARPVPDNGGDLVDVLINLCKEHDGTLRFTRDHVKAIVLDTFIGAIDTSSVTILWAMSELMRKPQV
LRKAQAEVRAAVGDDKPRVNSEDAAKIPYLKMVVKETLRLHPPATLLVPRETMRDTTICGYDVPANTRVF
VNAWAIGRDPASWPAPDEFNPDRFVGSDVDYYGSHFELIPFGAGRRICPGLTMGETNVTFTLANLLYCYD
WALPGAMKPEDVSMEETGALTFHRKTPLVVVPTKYKNRRAA

CYP170A1 (from Streptomyces Coelicolor)    SEQ ID NO:99
mTVESVNPETRAPAAPGAPELREPPVAGGGVPLLGHGWRLARDPLAFMSQLRDHGDVVRIKLGPKTVYA
VTNPELTGALALNPDYHIAGPLWESLEGLLGKEGVATANGPLHRRQRRTIQPAFRLDAIPAYGPIMEEEAH
ALTERWQPGKTVDATSESFRVAVRVAARCLLRGQYMDERAERLCVALATVFRGMYRRMVVPLGPLYRL
PLPANRRFNDALADLHLLVDEIIAERRASGQKPDDLLTALLEAKDDNGDPIGEQEIHDQVVAILTPGSETIAS
TIMWLLQALADHPEHADRIRDEVEAVTGGRPVAFEDVRKLRHTGNVIVEAMRLRPAVWVLTRRAVAESEL
GGYRIPAGADIIYSPYAIQRDPKSYDDNLEFDPDRWLPERAANVPKYAMKPFSAGKRKCPSDHFSMAQLT
LITAALATKYRFEQVAGSNDAVRVGITLRPHDLLVRPVAR

CYP76B6 (from Swertia mussotii)    SEQ ID NO:100
mDFDFLTIAIGFLFTITLYQALNFFSRKSKNLPPGPSPLPLIGNLHLLGDQPHKSLAKLAKKHGPIMGLQLGQ
VTTIVVTSSGMAKEVLQKQDLAFSSRSIPNAIHAHDQYKYSVIWLPVASRWRGLRKALNSNMFSGNRLDA
NQHLRSRKVQELIAYCRKSSQTGDAIDVGRAAFRTSLNLLSNTMFSKDLTDPYSDSAKEFKDLVWNVMVE
AGKPNLVDYFPLLDKVDPQGIRKRMTIHFGKILELFGGLIDERLQQKKAKGVNDDVLDVLLTTSEESPEEID
RTHIQRMCLDLFVAGTDTTSSTLEWAMSEMLKNPEKMKAAQAELAQVIGKGKAVEEADLARLPYLRCAIK
ETLRIHPPVPLLIPRRTEQEVEVCGYTVPKNSQVLVNVWAISRDDAIWKDPLSFKPERFLESELEMRGKDF
ELIPFGAGRRICPGLPLAVRMVPVMLGSLLNSFDWKLEGGIAPKDLDMEEKFGITLQKAHPLRAVATPL

CYP80A1 (from Berberis stolonifera)  SEQ ID NO:101
mDYIVGFVSISLVALLYFLLFKPKHTNLPPSPPAWPIVGHLPDLISKNSPPFLDYMSNIAQKYGPLIHLKFGL
HSSIFASTKEAAMEVLQTNDKVLSGRQPLPCFRIKPHIDYSILWSDSNSYWKKGRKILHTEIFSQKMLQAQ
EKNRERVAGNLVNFIMTKVGDVVELRSWLFGCALNVLGHVVFSKDVFEYSDQSDEVGMDKLIHGMLMTG
GDFDVASYFPVLARFDLHGLKRKMDEQFKLLIKIWEGEVLARRANRNPEPKDMLDVLIANDFNEHQINAM
FMETFGPGSDTNSNIIEWALAQLIKNPDKLAKLREELDRVVGRSSTVKESHFSELPYLQACVKETMRLYPP
ISIMIPHRCMETCQVMGYTIPKGMDVHVNAHAIGRDPKDWKDPLKFQPERFLDSDIEYNGKQFQFIPFGS
GRRICPGRPLAVRIIPLVLASLVHAFGWELPDGVPNEKLDMEELFTLSLCMAKPLRVIPKVRI

CYP81E1 (from Glycyrrhiza echinata) SEQ ID NO:102
mEILSLLSYSVFYLALFFIFNIVIRARKFKNLPPGPPSLPIIGNLHHLKRPLHRTFKGLSEKYGHVFSLWFGSR
LVVVVSSASEFQQCFTKNDVVLANRPRFLSGKYIFYNYTTLGSTSYGEHWRNLRRITALDVLSNHRINSFS
GIRRDETQRLITRLADDSSTNFAEMELSSRLYDMTFNNIMRMISGKRYYGEDCDTSDLQEASQFRDMVSE
LLQLSGANNKTDFMPLLRFLDFENLEKRLKDISGKTDAFLRGLIEEHRTKKERANTMIDHLLNLQDSQPEY
YTDQIIKGLALAMLLAGTDSSAVTLEWSMSNLLNHPEVLKKVKDELDTHVGQDRLVDESDLPKLTYLKNVI
NETLRLYTPAPLLLPHSTSDECNIGGYKVPQDTIVLINAWAIHRDPELWTEATTFKPERFEKKGELEKLIAF
GMGRRACPGEGLAIRAISMTLALLIQCFDWKLINGDKIDLAERDGFTLTKLVPLKAMCKSRPVINKVFKQ

CYP88A1 (from Zea mays)    SEQ ID NO:103
mLGVGMAAAVLLGAVALLLADAAARRAHWWYREAAEAVLVGAVALVVVDAAARRAHGWYREAALGAAR
RARLPPGEMGWPLVGGMWAFLRAFKSGKPDAFIASFVRRFGRTGVYRSFMFSSPTVLVTTAEGCKQVL
MDDDAFVTGWPKATVALVGPRSFVAMPYDEHRRIRKLTAAPINGFDALTGYLPFIDRTVTSSLRAWADHG
GSVEFLTELRRMTFKIIVQIFLGGADQATTRALERSYTELNYGMRAMAINLPGFAYRGALRARRRLVAVLQ
GVLDERRAARAKGVSGGGVDMMDRLIEAQDERGRHLDDDEIIDVLVMYLNAGHESSGHITMWATVFLQE
NPDMFARAKAEQEAIMRSIPSSQRGLTLRDFRKMEYLSQVIDETLRLVNISFVSFRQATRDVFVNGYLIPK
GWKVQLWYRSVHMDPQVYPDPTKFDPSRWEGHSPRAGTFLAFGLGARLCPGNDLAKLEISVFLHHFLL
GYKLARTNPRCRVRYLPHPRPVDNCLAKITRVGS

FIG. 17-25

CYP92A5 (from Nicotiana tabacum)    SEQ ID NO:104
mEGTNLTTYAAVFLGTLFLLLLSKFLRQRKLNLPPGPKPWPIIGNLNLIGNLPHRSIHELSLKYGPIMQLQFG
TFPVVVGSSVEMAKVFLKSMDINFVGRPKTAAGKYTTYNYSDITWSPYGPYWRQARRMCLMELFSTKRL
DSYEYIRAEELHSLLHNLNKISGKPIVLKDYLTTLSLNVISRMVLGKRYLDESENSIVTPEEFKKMLDELFLLN
GVLNIGDSIPWIDFMDLQGYVKRMKFVSKKFDKFLEHVIDEHNVRRNGVENYIAKDMVDVLLQLADDPTLE
VKLERHGVKAFTQDMLAGGTESSAVTVEWAISELLKKPEIFKKATEELDRVIGQNRWVQEKDIPNLPYIEAI
VKETMRLHPVAPMLVPRECREDCKVAGYDVKKGTRVLVSVWTIGRDPTLWDEPEAFKPERFHEKSIDVK
GHDFELLPFGAGRRMCPGYNLGLKVIQASLANLIHGFNWSLPDNMTPEDLDMDEIFGLSTPKKFPLATVIE
PRLSPKLYSV

CYP96C1 (from Catharanthus roseus) SEQ ID NO:105
mALASIEKVATGLICFILLIFSLKRIGHPRDWALVGILSVWFPSLGHIYEKLAKSLAKNDKTFVLKGSFLSKQD
VIFTCDPANMHHVMSTNFSNYPKGPENRNVFDVYGEMLFTADHEKWKSHRKVTNAYFHDQRFNGFSQK
VNKEVIEKELFPFLDHAAEEALVFDLQDVFQRLMLDSSSILTTGQNHRSLRVGLPYDETLEAINIANYQIFVR
HILPAKIWKFQKWLGIMGEKKIKKAWRILDDISVEYMNRRKKEISSTISSQEDMDVVKFSEEDHVVLKSVDA
SDNLLRDTVKGILLAGTDTTATVLSWFFWLILKNPRVEQKIREEIELYLKQKNGEHGLYTNPEELNELMYLH
AAIYETMRLYPAAPFTSRKSIQADVFPTGHQVNPNTTIVMAYYAVGRMKSIWGEDCLEFKPERWLSDKGK
LIPVQTNKFLAFGTGPRICPGKELGLNRVKAVAAAIIPKYSFKIMRNKPVMPAACATLYLKDGLIVRVNKII

CYP720B1 (from Pinus taeda) SEQ ID NO:106
mADQISLLLVVFTAAVALLHLIYRWWNAQRGQKRTSNEKNQELHLPPGSTGWPLIGETYSYYRSMTSNRP
RQFIDDREKRYDSDVFVSHLFGSQAVISSDPQFNKYVLQNEGRFFQAHYPKALKALIGDYGLLSVHGDLQ
RKLHGIAVNLLRFERLKFDFMEEIQNLVHSTLDRWVDKKEIALQNECHQMVLNLMAKQLLDLSPSKETNEI
CELFVDYTNAVIAIPIKIPGSTYAKGLKARELLIRKISNMIKERRDHPHIVHKDLLTKLLEEDSISDEIICDFILFL
LFAGHETSSRAMTFAIKFLTTCPKALTQMKEEHDAILKAKGGHKKLEWDDYKSMKFTQCVINETLRLGNF
GPGVFRETKEDTKVKDCLIPKGWVVFAFLTATHLDEKFHNEALTFNPWRWELDQDVSNNHLFSPFGGGA
RLCPGSHLARLELALFLHIFITRFRWEALADEHPSYFPLPYLAKGFPMRLYNRE

CYP710A11 (from Olanum lycopersicum)    SEQ ID NO:107
mASIWGLLSPWIPYFISFIAFLLLLEQISYIKKKRFLPGPTLVFPFLGNVIPLVTNPTKFWDLQSALAKSTSHG
FSVNYIIGKFILYIHSTDLSHKVFANVRPDAFHLIGHPFGKKLFGEHNLIYMFGQEHKDLRRRIAPNFTPKAL
GTYTDIQQRIIKHFKSWLDEASKSPNTPIPLRLLCRDMNLDTSQAVFVGPYLDGESRKRFNVDYNYFNVG
LMKLPVDLPGFAFRNARLAVGRLVDTLSVCVEQSLNKMKNEEEPTCLIDFWMQENLREINEAKINGLQKP
FQYSNKELGGYLFDFLFAAQDASTSALLWAIVLLDSHPQVLEKVRSDVARFWSPESEEPLTAEMLREMKY
LEAVAREIIRIRAPATMVPHIAGEEFRLTEDYVIPKGTIVFPSVFDSSFQGFPEPEKFEPDRFMEERQEERV
YKKNFLAFGAGPHACVGQKYAINHLMLFIAMFTALIDFKRHKTDGCDDISYIPTIAPKDDCKVFLAHRCTR

CYP726A1 (from Uphorbia lagascae) SEQ ID NO:108
mEQKNLSFPSILISFLLVLILVVVMRLWKKQNPPPGPWKFPIIGNLPHLLLTSDLGHERFRALAQIYGPVMSL
QIGQVSAVVISSAEAAKEVMKTQADAFAQRPIVLDAQIVFYNRKDVLFASYGDHWRQMKKIWILEFLSAKK
VQSSRLIREEEMEDAITFLRSKAGSPVNITKIIYGIIISIMIRTSVGNCKQKERLLSVADAVNEAATSFGTADAF
PTWKLLHYIIGAESKPRRLHQEIDDILEEILNEHKANKPFEADNLMDVLLNLQKNGNVPVPVTNESIKASVL
QMFTAGSETTSKATEWVMAELMKNPTELRKAQEEVRQVFGEMGKVDESRFHDLKFFKLVVKETLRLHPP
VVLIPRECRETTRIDGYEIHPNTRIVVNAWAIGRDPNTWSEPGKFNPERFKDCAIDYKGTTFELVPFGAGK
RICPGITSAITNLEYVIINLLYHFNWELADGITPQTLDMTEAIGGALRKKIDLKLIPIPYQVSLGSNIS

CYP165A3 (P450oxyA) (from Amycolatopsis orientalis)    SEQ ID NO:109
mFEEKNALRGTEIHRRERFDPGPELRALMAEGRMSVMESEESPGGRTGWLATGYEETRQVLGSDKFSA
KLLFGGTAAGRIWPGFLNQYDPPEHTRLRRMVASAFTVRRMRDFRPRIEAVVKATLDDIEATGGPVDFVP
RFAWPIATTVICDFLGIPRDDQAELSRVLHASRSERSGKRRVAAGNKYWTYMGQVAAKTRRDPGDDMFG
AVVREHGDDITDAELLGVAAFVMGASGDQVARFLSAGAWLMVEHPEQFAVLRDDPDSVPDWLNEVARY
LTSDEKTTPRIALEDVRIGDQLVKKGDAVTCSLLASNRHRFPDPEDRFDITREKPSHVTFGHGIHHCLGRP
LAEMVFRTAIPALAHRFPTLRLAEPDREIKLGPPPFDVEALLLDW

FIG. 17-26

CYPX-P450oxyB (from Amycolatopsis orientalis)    SEQ ID NO:110
mSEDDPRPLHIRRQGLDPADELLAAGALTRVTIGSGADAETHWMATAHAVVRQVMGDHQQFSTRRRWD
PRDEIGGKGIFRPRELVGNLMDYDPPEHTRLRRKLTPGFTLRKMQRMAPYIEQIVNDRLDEMERAGSPAD
LIAFVADKVPGAVLCELVGVPRDDRDMFMKLCHGHLDASLSQKRRAALGDKFSRYLLAMIARERKEPGE
GMIGAVVAEYGDDATDEELRGFCVQVMLAGDDNISGMIGLGVLAMLRHPEQIDAFRGDEQSAQRAVDELI
RYLTVPYSPTPRIAREDLTLAGGQEIKKGDSVICSLPAANRDPALAPDVDRLDVTREPIPHVAFGHGVHHCL
GAALARLELRTVFTELWRRFPALRLADPAQDTEFRLTTPAYGLTELMVAW

CYPX-P450oxyC (from Amycolatopsis orientalis)    SEQ ID NO:111
mGHDIDQVAPLLREPANFQLRTNCDPHEDNFGLRAHGPLVRIVGESSTQLGRDFVWQAHGYEVVRRILG
DHEHFTTRPQFTQSKSGAHVEAQFVGQISTYDPPEHTRLRKMLTPEFTVRRIRRMEPAIQSLIDDRLDLLE
AEGPSADLQGLFADPVGAHALCELLGIPRDDQREFVRRIRRNADLSRGLKARAADSAAFNRYLDNLLARQ
RADPDDGLLGMIVRDHGDNVTDEELKGLCTALILGGVETVAGMIGFGVLALLDNPGQIELLFESPEKAERV
VNELVRYLSPVQAPNPRLAIKDVVIDGQLIKAGDYVLCSILMANRDEALTPDPDVLDANRAAVSDVGFGHG
IHYCVGAALARSMLRMAYQTLWRRFPGLRLAVPIEEVKYRSAFVDCPDQVPVTW

CypX-epothilone b hydroxylase (from Streptomyces sp. AA4) SEQ ID NO:112
mTEVAQPSRTQPEQAAFPMKRTCPFAPPPEYDRFRDARAHYVELERSGQRAWVLHRHEDLRAMLNDP
RFSSDRFNPGFPVLFKDGLQRRPKLRPSLIGMDAPEHGPARRGVVGEFTVKRMKALQPRIQEIVDEHLDA
MLAGDQTADLVSALSLPVPSLVICEQLGVPYADHDFFQKHSSRLLNREISADERGASVEAMQKYLSDLVS
AKETAPADDLLSRQIEKKREEGSYDHDDLVSLAFLLLIAGHETTANMISLGTVALLENPDALAAIKEDPGKTL
DAVEELLRYFTIAEFATTRVALEDVDIAGVTIKAGEGVLGLSYAANFDPEVFPEPEQFDISRGGRHHVAFGF
GAHQCLGQNLARMELQIVFDTLFRRIPTLRLAAPVEALPFKHDSGVFGLYCLPVAW

CypX-EpoK (from Sorangium cellulosum)    SEQ ID NO:113
mTQEQANQSETKPAFDFKPFAPGYAEDPFPAIERLREATPIFYWDEGRSWVLTRYHDVSAVFRDERFAV
SREEWESSAEYSSAIPELSDMKKYGLFGLPPEDHARVRKLVNPSFTSRAIDLLRAEIQRTVDQLLDARSG
QEEFDVVRDYAEGIPMRAISALLKVPAECDEKFRRFGSATARALGVGLVPRVDEETKTLVASVTEGLALLH
GVLDERRRNPLENDVLTMLLQAEADGSRLSTKELVALVGAIIAAGTDTTIYLIAFAVLNLLRSPEALELVKAE
PGLMRNALDEVLRFDNILRIGTVRFARQDLEYCGASIKKGEMVFLLIPSALRDGTVFSRPDVFDVRRDTSA
SLAYGRGPHVCPGVSLARLEAEIAVGTIFRRFPEMKLKETPVFGYHPAFRNIESLNVILKPSKAG

CypX-PicK (from Streptomyces venezuelae)    SEQ ID NO:114
mRRTQQGTTASPPVLDLGALGQDFAADPYPTYARLRAEGPAHRVRTPEGDEVWLVVGYDRARAVLADP
RFSKDWRNSTTPLTEAEAALNHNMLESDPPRHTRLRKLVAREFTMRRVELLRPRVQEIVDGLVDAMLAA
PDGRADLMESLAWPLPITVISELLGVPEPDRAAFRVWTDAFVFPDDPAQAQTAMAEMSGYLSRLIDSKRG
QDGEDLLSALVRTSDEDGSRLTSEELLGMAHILLVAGHETTVNLIANGMYALLSHPDQLAALRADMTLLDG
AVEEMLRYEGPVESATYRFPVEPVDLDGTVIPAGDTVLVVLADAHRTPERFPDPHRFDIRRDTAGHLAFG
HGIHFCIGAPLARLEARIAVRALLERCPDLALDVSPGELVWYPNPMIRGLKALPIRWRRGREAGRRTG

CypX-EryK (from Saccharopolyspora erythraea) SEQ ID NO:115
mFADVETTCCARRTLTTIDEVPGMADETALLDWLGTMREKQPVWQDRYGVWHVFRHADVQTVLRDTAT
FSSDPTRVIEGASPTPGMIHEIDPPEHRALRKVVSSAFTPRTISDLEPRIRDVTRSLLADAGESFDLVDVLA
FPLPVTIVAELLGLPPMDHEQFGDWSGALVDIQMDDPTDPALAERIADVLNPLTAYLKARCAERRADPGD
DLISRLVLAEVDGRALDDEEAANFSTALLLAGHITTTVLLGNIVRTLDEHPAHWDAAAEDPGRIPAIVEEVLR
YRPPFPQMQRTTTKATEVAGVPIPADVMVNTWVLSANRDSDAHDDPDRFDPSRKSGGAAQLSFGHGVH
FCLGAPLARLENRVALEEIIARFGRLTVDRDDERLRHFEQIVLGTRHLPVLAGSSPRQSA

CYPX (from Ozonium sp. BT2)    SEQ ID NO:116
mDSFIFLRSIGTKFGQLESSPAILSLTLAPILAIILLLLFRYNHRSSVKLPPGKLGLPLIGETIQLLRTLRSETPQ
KFFDDRLKKFGPVYMTSLIGHPTVVLCGPAGNKLVLSNEDKLVEMEGPKSFMKLIGEDSIVAKRGEDHRIL
RTALARFLGAQALQNYLGRMSSEIGHHFNEKWKGKDEVKVLPLVRGLIFSIASTLFFDVNDGHQQKQLHH
LLETILVGSSSVPLDFPGTRYRKGLQARLKLDEILSSLIKRRRRDLRSGIASDDQDLLSVLLTFRDEKGNSLT
DQGILDNFSAMFHASYDTTVAPMALIFKLLYSNPEYHEKVFQEQLEIIGNKKEGEEISWKDLKSMKYTWQA
VQESLRMYPPVFGIFRKAITDIHYDGYTIPKGWRVLCSPYTTHLREEYFPEPEEFRPSRFEDEGGHVTPYT
YVPFGGGLRTCPGWEFSKIEILLFVHHFVKNFSSYIPVDPNEKVLSDPLPPLPANGFSIKLFPRS

FIG. 17-27

CYPX (from Lactuca sativa)  SEQ ID NO:117
mELSITTSIALATIVFFLYKLATRPKSTKKQLPEASRLPIIGHMHHLIGTMPHRGVMDLARKHGSLMHLQLGE
VSTIVVSSPKWAKEILTTYDITFANRPETLTGEIIAYHNTDIVLAPYGEYWRQLRKLCTLELLSVKKVKSFQSI
REEECWNLVKEVKESGSGKPINLSESIFTMIATILSRAAFGKGIKDQREFTEIVKEILRQTGGFDVADIFPSK
KFLHHLSGKRARLTSIHKKLDNLINNIVAEHHVSTSSKANETLLDVLLRLKDSAEFPLTADNVKAIILDMFGA
GTDTSSATVEWAISELIRCPRAMEKVQAELRQALNGKEKIQEEDIQDLAYLNLVIRETLRLHPPLPLVMPRE
CREPVNLAGYEIANKTKLIVNVFAINRDPEYWKDAEAFIPERFENNPNNIMGADYEYLPFGAGRRMCPGA
ALGLANVQLPLANILYHFNWKLPNGASHDQLDMTESFGATVQRKTELLLVPSF

CYPX-RadP (from Chaetomium chiversii)      SEQ ID NO:118
mAEFHPTAFLLPAAVTMIAGYFLCTALYNVYFHPLAKFPGPRLYAASQIPITIKRLLGDEVATFHKLHAKYG
QFVRVAPGELSTINPAASRDVYGHRNPAKSIPKDFKAYYMKNQRRDGTEGLMTADDDLHRRQRKIFSPA
FSDRAIREQEPLLKKYTDLLVEKAGVASDADGKVDMVMMFNFATFDFIADCVFGDSLHLLEKMEYNPFLA
NISAVVKFSAMRRAIRSFPYMDETFEKLIPASMKRKRMEHVKFCDDLVDRRLEKAVTNHPDFWTLVLRAN
EKGEGLTLGEMHQNSFLFLTAATETTSSLMSALTYLLCQNPDKMKKLVDEIRGRFKSTEEMTTVSLPPLEY
LQMCIEEGLRVYPPVPGGLPRRVTADGASLDGRELPPDTVVYYAHYASYHSAAHFARPDEFHPERWASV
PPSEFANDCRDAVIPFSAGPRDCIGKNLAYHEARLLLAKFLWTYDVELCEESKDWIKQKSFIVGVKRPLYV
KLHRVVREK

CYPX-Rdc4 (from Metacordyceps chlamydosporia)      SEQ ID NO:119
mNVSPQLLGYVVYTAIYNVYFHPLANFPGPKYLAASRIPLAFKRLTGEEVAMTYKLHIKYGPYVRVSPDEL
STISTAATKDVYGHNTRAGGVPKDFKAYYMKNQRKDGTEGLLTAGDEEHYRQRKVFAPAFSDRAIREQE
PLLKKYTDLLVAKSYEKCQTAGKVDMVMFFNFATFDFIADCVFGDSLHHLESMEYHPFLANITATVRFSAM
RRVLRSFPILQAIFEAFMPKSMIKKRLEHVKFCDERVMNRLANDNPSHPDFWTLVEHAEAKGNGLTKGEM
RQNGFLLLTAATETTSSLMSAITYLLCKNPEKMKKLQAEVRGAFKSTDEMNTITLPKLQYLQMAIEEGLRV
YPPVPGGLPRRVVQPGTTLDGSASNMHIQSVVFYSQYASYHSPSHFARPHEFIPERWSQNPPAEFANDR
LEAVQAFSAGPRDCIGKNLAYHEARMLLAKFVFTYDIELCKESSDWIKQKVYIVGAKSPLWVKLVKHERAD

CYPX-Hpm1 (from Hypomyces subiculosus)   SEQ ID NO:120
mAVLPQVDLGHLANRDTAFVIVGAFFAWVFVVNPIYLLYFHPLSKFPGPKFWAVTRWGVSLAIISGKSHDII
LDLHKKYGPILRIAPDELAFQSVSAWNDIGGHRKPGQPEMTKEPIFNEAFKDNLLGVTTREDHSRMRRILS
RGFSAATFQKQEPLLKGYVDLLLSELKKRCEGGQKLIDIQTWYSFTAFDIIGDLTFGESFGSLDSGGHHPW
ASLIFETTRFVILANCLKRINRAFLPVLLFITPKGFGRRLKENQQLTDAKIAKRRALGASRPDYMTAMLGND
EKGAKLSDTEITSNCTALILGGAETISSALSGTTYYLTKNPEAMAKVIEEVRSAFSSEDEITLTGTGHLKYLN
AVITESLRMFPPFAGASPRQVPRGGATIAGEFIPAGTSVGIWHWSMARCPDFFTHANEFHPERWLDDPR
FDNDKKDASQPFAVGPRNCIGMNLTYVELRLILARLFWNFDIKLDKSCDNWVDDMVEYFGWEKIPLMVSL
TPRS

CYPX-AmphN (from Streptomyces nodosus)   SEQ ID NO:121
mTAETEMTTFAPGCPVAFPLRRPGRPFPPPEYADYRAGEGLVRSELPASGPVWLVTRHEDVRTVLTDPR
ISADPSRPGFPRARRTGGAPSQSEIPGWFVALDPPEHDRFRKTLIPEFTVRKVRELRPAIQQIVDERIDALL
AAGNSADLIADFALSVPSLVISDLLGVPKADRDFFEAKTKVLVTLSSTDEQRDEASKALLRYLNRLIQIKGR
RPGEDLISRLLQAGTMNRQELSGVSMLLLIAGHETTANNIGLGVVQLLTNPQWIGDDRIVEEMLRYYSVAD
LVSFRVAVEDVEIGGQLIKAGEGIVPLIAAANHDGSVFDKPEEFNPERSARSHVAFGYGVHQCLGQNLVR
VEMEIAYRTLFERIPTLELAVPVEELPLKYDGVLFGLHELPVTWS

CYPX-AmphL(from Streptomyces nodosus)      SEQ ID NO:122
mVNPTPPPSLEDAAPSVLRLSPLLRELQMRAPVTKIRTPAGDEGWLVTRHAELKQLLHDERLARAHADPA
NAPRYVKSPLMDLLIMDDVEAARAAHAELRTLLTPQFSARRVLNMMPMVEGIAEQILNGFAAQEQPADLR
GNFSLPYSLTVLCALIGIPLQEQGQLLAVLGEMATLNDAESVARSQAKLFGLLTDLAGRKRAEPGDDVISR
LCETVPEDERIGPIAASLLFAGLDSVATHVDLGVVLFTQYPDQLKEALADEKLMRSGVEEILRAAKAGGSG
AALPRYATDDIEIADVTIRTGDLVLLDFTLVNFDEAVFDDADLFDIRRSPNEHLTFGHGMWHCIGAPLARM
MLKTAYTQLFTRLPGLKLASSVEELQVTSGQLNGGLTELPVTW

CYPX (from Haemophilus parasuis)   SEQ ID NO:123
mLFDGRVNGKKHFLSIAKSFLELFDYFKKSFNDSDENISDMVVTYIAAHQTTMQLIVATLYTIHNFNLTVDK
SNIKNIILESSRLYSPVLSVGRIVTKDIHYCRNIIKKGDRAIFYTGLANFDSNSFVLPFTFNLDRINKPLSFGVG
IHKCIGMGISLDFTKIFVEFILEKYKLKNVSIFKVDDGASAIGISSFTIEINKK

FIG. 17-28

CYP167A1 (from Sorangium cellulosum)         SEQ ID NO:124
mTQEQANQSETKPAFDFKPFAPGYAEDPFPAIERLREATPIFYWDEGRSWVLTRYHDVSAVFRDERFAV
SREEWESSAEYSSAIPELSDMKKYGLFGLPPEDHARVRKLVNPSFTSRAIDLLRAEIQRTVDQLLDARSG
QEEFDVVRDYAEGIPMRAISALLKVPAECDEKFRRFGSATARALGVGLVPRVDEETKTLVASVTEGLALLH
GVLDERRRNPLENDVLTMLLQAEADGSRLSTKELVALVGAIIAAGTDTTIYLIAFAVLNLLRSPEALELVKAE
PGLMRNALDEVLRFDNILRIGTVRFARQDLEYCGASIKKGEMVFLLIPSALRDGTVFSRPDVFDVRRDTSA
SLAYGRGPHVCPGVSLARLEAEIAVGTIFRRFPEMKLKETPVFGYHPAFRNIESLNVILKPSKAG

CYPX-Ebh(from Amycolatopsis orientalis)     SEQ ID NO:125
mTDVEETTATLPLARKCPFSPPPEYERLRRESPVSRVGLPSGQTAWALTRLEDIREMLSSPHFSSDRQSP
SFPLMVARQIRREDKPFRPSLIAMDPPEHGKARRDVVGEFTVKRMKALQPRIQQIVDEHIDALLAGPKPAD
LVQALSLPVPSLVICELLGVPYSDHEFFQSCSSRMLSREVTAEERMTAFESLENYLDELVTKKEANATEDD
LLGRQILKQRESGEADHGELVGLAFLLLIAGHETTANMISLGTVTLLENPDQLAKIKADPGKTLAAIEELLRIF
TIAETATSRFATADVEIGGTLIRAGEGVVGLSNAGNHDPDGFENPDTFDIERGARHHVAFGFGVHQCLGQ
NLARLELQIVFDTLFRRVPGIRIAVPVDELPFKHDSTIYGLHALPVTW

CYPX-PksS(from Paenibacillus sp. HGF5)     SEQ ID NO:126
mNVNESLKNALFTKEFTHNPYPVYEKLRQSDPIMNLQFPDGRHGWLISSYAEAVEALKDGRFSKDVTKA
MGAEQTSVFSTNMLFSDPPDHKRLRGLVQKGFTPQRIADMRSHIQEIADNLLDAVSSKDTMNLIDEYAFKL
PIIVISEILGVPAEDQDKFRVWSNSIIGASNQEMNEQVVQHMNEFIDYLKDWFAKVRELPGDDMISQLVIAE
NQGDRLSEQELYGVVTLMIIAGHETTVNLIGNGVLALLEHPEQRKLLQEQPERIHGAIEEMLRYNGPVEFS
TSRWAAEDLEFHGVHMKKGDLVVIALNSANRDSAQFEDPDLFDITREKSQHLAFGKGIHLCLGAPLARLE
GEIAINTLLRRFPDFELQGNIDELEWRPGMIVRGVKEIPISLRS

CYP102B1 (from Streptomyces coelicolor)     SEQ ID NO:127
mAQTAREPARDGLPKGFRSAELGWPELHRIPHPPYRLPLLGDVVGASRRTPMQDSLRYARRLGPIFRRR
AFGKEFVFVWGAALAADLADEARFAKHVGLGVANLRPVAGDGLFTAYNHEPNWQLAHDVLAPGFSREA
MAGYHVMMLDVAARLTGHWDLAEASGRAVDVPGDMTKLTLETIARTGFGHDFGSFERSRLHPFVTAMV
GTLGYAQRLNTVPAPLAPWLLRDASRRNAADIAHLNRTVDDLVRERRANGGTGGGTGSGSGSGDLLDR
MLETAHPRTGERLSPQNVRRQVITFLVAGHETTSGALSFALHYLAQHPDVAARARAEVDRVWGDTEAPG
YEQVAKLRYVRRVLDESLRLWPTAPGFAREAREDTVLGGTHPMRRGAWALVLTGMLHRDPEVWGADA
ERFDPDRFDAKAVRSRAPHTFKPFGTGARACIGRQFALHEATLVLGLLLRRYELRPEPGYRLRVTERLTL
MPEGLRLHLVRRTAAAPAPGRRTAAPGAADDAGDTVSAPGCPVHRAGD

CYP102B2 (from Streptomyces avermitilis)     SEQ ID NO:128
mAQSTRTVIPKGFRSAELGWPELHRIPHPPHRLPVVGDVLGVNVRTPVQDSLRIGRRLGPVFRRKAFGKE
IVFVGGADLAAELADESRFAKHVGLGVANLRPVAGDGLFTAYNHEPNWQLGHDVLAPGFSREAMAGYHP
MMLAVTERLIDHWDREQTAGRAVDVPGDMTKLTLETIARTGFGHDFGSFERARPHPFVTAMVGTLTYAQ
RRNVVPEPLAPLLLRTATRRNAADLAYLNRTVDALVRARRTTSGEGDLLDRMLDTARPGTGERLAPENIR
RQVITFLVAGHETTSGALSFALHYLSRHPDVAARARAEVDRVWGGTARPGYDQVAKLRYVRRVLDESLR
LWPTAPAFAREARRDTVLGGVHPMREGAWALVLTAMLHRDPGVWGADAERFDPDRFDAQAVRSRAAH
TFKPFGTGARACIGRQFALHEATLVLGLLLRRYELRAEPGYRLRVAERLTLMPEGLRLRLDRRVPAVEDV
PVANPEVSSGPRCPVTGAGE

CYP102C2 (from Rhodococcus erythropolis)     SEQ ID NO:129
mNGPRGSRTRPRRASLVNLAVLGVVLVHTVLMSADKCPYPKSATRAGEITAVQPQVFESIPSPAWRLPLL
GDLLTVDSEKPIQKEMALASKLGPIFEWKIVNNRVTVVSGVDLVAEVNNEALWAKSVGLPILKLRKVAEDG
LFTAFNSEPNWRKAHNILSEGFSRSALRNYHPSMLRALGGLTDSWDRVADAGETIDASSDANKLALDVIG
LAGFGYDFASFIGEEHPFVGAMSRVLAHVNSTSNDIPFLRKLRGNGADLQNEKDIALLRTVVDNVIAERQS
KPGEHQDDLLDLMLHSADAETGEKLDPVNIRNQVFTFLVAGNETTAGTLAFALYFLSRHPDVADTARAEV
ADVTAGETPAFEDVARMRYLRRVVDETLRLWPSAPGYFRKVRTDTTLGGRYDMPKGSWVFVLLPQLHR
DPVWGEDPESFDPDRFKPENVKKRPAHAYRPFGTGPRACIGRQFALHEAVLALAIILQRYNFQSDPEYKL
DIRETLSLKPVGFELSLQRR

FIG. 17-29

CYP102H1 (from Nocardia farcinica)    SEQ ID NO:130
mAVTTSTTSGGHSNPPLPHPKWRLPIINDLLTINPIKPTLTSLRDAEQLGGIFERRLVDWPMIVVSDSELITEI
CDERNWAKHLGVPLRKMRHIARDGLFTARNDEPNWAKAHAVLAPAFTKEAMRSYHQTMLTTIGELLDYW
AKRDGQWVDVGEDMNKLTLEIIARTGFDYTFDSFTRSEVHPFVAAMLRGLTYISRNSNMPPFLQKTIGAR
AAARHSRDITYVRTVVDDVIKARQASGTVGDHHDLLDRMLTVPDPASDELLDTTNVRSQILTMLVAGHET
SAGVLAFALYELSRRPELVAAARAEIETRFADGDLSTIAYDDVAKLRTLRRIVDETLRLYPVAPGFFREARH
ETTIGGGRYRFGPGDWVLVLTLHAHRDPATWGPDAGEFQPDRWLPERMRSLDGRQVFKPFGTGLRACI
GRQFAYHEIVLALAHILHTFEFTPDPGYELDIAEQITLKPHRFRLRLNHR

CYP101B1 (from Novosphingobium aromaticivorans)        SEQ ID NO:131
mLPHDRGQNSTRRITAMEAPAHVPADRVVDIDIYMPPGLAEHGFHKAWSDLSAGNPAVVWTPRNEGHWI
ALGGEALQEVQSDPERFSSRIIVLPKSVGEMHGLIPTTIDPPEHRPYRQLLNAHLNPGAIRGLSESIRQTAV
DLIEGFAAQGHCNFTAQYAEQFPIRVFMALVGIEASEAPRIRHWAECMTRPGMDMTFDEAKAVFFDYVGP
LVDARRETPGEDMISAMINADLGDGRRLTRDEALSVVTQVLIAGLDTVVNVLGFIMRELAGNPALRADLRQ
RGADILPVVHELFRRFGLVSIAREVRRDIEFHGVHLKAGDMIAIPTQVHGLDPRVNPDPLAIDPSRKRARHS
TFGSGPHMCPGQELARKEVAITLEEWLRRIPDFALGPNSDLSPVPGIVGALRRVELVWNT

CYP101C1 (from Novosphingobium aromaticivorans)        SEQ ID NO:132
mIPAHVPADRVVDFDIFNPPGVEQDYFAAWKTLLDGPGLVWSTANGGHWIAARGDVVRELWGDAERLS
SQCLAVTPGLGKVMQFIPLQQDGAEHKAFRTPVMKGLASRFVVALEPKVQAVARKLMESLRPRGSCDFV
SDFAEILPLNIFLTLIDVPLEDRPRLRQLGVQLTRPDGSMTVEQLKQAADDYLWPFIEKRMAQPGDDLFSRI
LSEPVGGRPWTVDEARRMCRNLLFGGLDTVAAMIGMVALHLARHPEDQRLLRERPDLIPAAADELMRRY
PTVAVSRNAVADVDADGVTIRKGDLVYLPSVLHNLDPASFEAPEEVRFDRGLAPIRHTTMGVGAHRCVGA
GLARMEVIVFLREWLGGMPEFALAPDKAVTMKGGNVGACTALPLVWRA

CYP101D1 (from Novosphingobium aromaticivorans)        SEQ ID NO:133
mNAQTSTATQKHRVAPPPHVPGHLIREIDAYDLDGLEQGFHEAWKRVQQPDTPPLVWTPFTGGHWIATR
GTLIDEIYRSPERFSSRVIWVPREAGEAYDMVPTKLDPPEHTPYRKAIDKGLNLAEIRKLEDQIRTIAVEIIEG
FADRGHCEFGSEFSTVFPVRVFLALAGLPVEDATKLGLLANEMTRPSGNTPEEQGRSLEAANKGFFEYV
APIIAARRGGSGTDLITRILNVEIDGKPMPDDRALGLVSLLLLGGLDTVVNFLGFMMIYLSRHPETVAEMRR
EPLKLQRGVEELFRRFAVVSDARYVVSDMEFHGTMLKEGDLILLPTALHGLDDRHHDDPMTVDLSRRDV
THSTFAQGPHRCAGMHLARLEVTVMLQEWLARIPEFRLKDRAVPIYHSGIVAAVENIPLEWEPQRVSA

CYP101D2 (from Novosphingobium aromaticivorans)        SEQ ID NO:134
mGTTRMDTFNPQESRLATNFDEAVRAKVERPANVPEDRVYEIDMYALNGIEDGYHEAWKKVQHPGIPDLI
WTPFTGGHWIATNGDTVKEVYSDPTRFSSEVIFLPKEAGEKYQMVPTKMDPPEHTPYRKALDKGLNLAKI
RKVEDKVREVASSLIDSFAARGECDFAAEYAELFPVHVFMALADLPLEDIPVLSEYARQMTRPEGNTPEE
MATDLEAGNNGFYAYVDPIIRARVGGDGDDLITLMVNSEINGERIAHDKAQGLISLLLLGGLDTVVNFLSFF
MIHLARHPELVAELRSDPLKLMRGAEEMFRRFPVVSEARMVAKDQEYKGVFLKRGDMILLPTALHGLDDA
ANPEPWKLDFSRRSISHSTFGGGPHRCAGMHLARMEVIVTLEEWLKRIPEFSFKEGETPIYHSGIVAAVEN
VPLVWPIAR

CYP101D3 (from Sphingomonas)    SEQ ID NO:135
mPEHVPETMSRARAPRPEHIPEQYVHEIDMYALEGIEQGYHEAWKNIPKPDMPDLIWTPFTGGHWIATNG
DTVREVYSDPTRFSSEVIFLPKEAGEKYEMVPTRMDPPEHTPYRKALDKGLSLAQIRKVESKVRKVAVDLI
DSFVSRGECDFSAEYANVFPVRVFMALADLPESDVPTLSRFAKMMTRPEGNTPEEMAKHLEEGNKGFFA
YVEPIIQARRGKEGEDLITVMVNAEINGERITHDKALGLISLLLLGGLDTVVNFLSFMMIHLAKNPQVVEELR
ADPLKLMRSAEEMFRRFPVVSEARMVAKDQDFRGIELKRGDMILLPTALHGLDDQLNDDPWRINLERRGI
SHSTFGGGPHRCAGLHLARMEVIVTIEEWLKRIPTFAMKPGAQPIYHSGIVAAVDNVPLIWSER

CYP105A1 (from Streptomyces griseolus)    SEQ ID NO:136
mTDTATTPQTTDAPAFPSNRSCPYQLPDGYAQLRDTPGPLHRVTLYDGRQAWVVTKHEAARKLLGDPRL
SSNRTDDNFPATSPRFEAVRESPQAFIGLDPPEHGTRRRMTISEFTVKRIKGMRPEVEEVVHGFLDEMLA
AGPTADLVSQFALPVPSMVICRLLGVPYADHEFFQDASKRLVQSTDAQSALTARNDLAGYLDGLITQFQT
EPGAGLVGALVADQLANGEIDREELISTAMLLLIAGHETTASMTSLSVITLLDHPEQYAALRADRSLVPGAV
EELLRYLAIADIAGGRVATADIEVEGHLIRAGEGVIVVNSIANRDGTVYEDPDALDIHRSARHHLAFGFGVH
QCLGQNLARLELEVILNALMDRVPTLRLAVPVEQLVLRPGTTIQGVNELPVTW

FIG. 17-30

CYP105B1 (from Streptomyces griseolus)      SEQ ID NO:137
mTTAERTAPPDALTVPASRAPGCPFDPAPDVTEAARTEPVTRATLWDGSSCWLVTRHQDVRAVLGDPR
FSADAHRTGFPFLTAGGREIIGTNPTFLRMDDPEHARLRRMLTADFIVKKVEAMRPEVQRLADDLVDRMT
TGRTSADLVTEFALPLPSLVICLLLGVPYEDHAFFQERSRVLLTLRSTPEEVRAAQDELLEYLARLARTKRE
RPDDAIISRLVARGELDDTQIATMGRLLLVAGHETTANMTALSTLVLLRNPDQLARLRAEPALVKGAVEELL
RYLTIVHNGVPRIATEDVLIGGRTIAAGEGVLCMISSANRDAEVFPGGDDLDVARDARRHVAFGFGVHQCL
GQPLARVELQIAIETLLRRLPDLRLAVPHEEIPFRGDMAIYGVHSLPIAW

CYP105C1 (from Streptomyces)      SEQ ID NO:138
mTQAAPVTFSTVRENYFGPPAEMQALRHKAPVTRTAFADGRPGWLVTGYSAARAVLSDSRFTARGERE
HPAVPRAATLEDERCRRLIAGQFTARRMRQLTGRTERIVREHLDAMEHMGSPADLVEHFALPVPSLVIAE
LLGVPPPDREHFQHDTLRWGGFGRSTEEVTEAFVSLGGQLQRLVRLKRTEPGDDLLSGLIAADPALTDEE
LASIAFLLLVAGHGTTAHQIALGAFLLLEHPDQLAALRADPALTESAVEELLRHLSVVHHGPTRAALQDADI
EGTPVKAGEVVVVSLGAANRDPARFERPDAVDVTREDTGHLAFGHGMHQCLGRQLARIELRVALTALLE
RFPHLRLACPAAEIPLRHDMQVYGADRLPVAW

CYP105D1 (from Streptomyces griseus)      SEQ ID NO:139
mTESTTDPARQNLDPTSPAPATSFPQDRGCPYHPPAGYAPLREGRPLSRVTLFDGRPVWAVTGHALAR
RLLADPRLSTDRSHPDFPVPAERFAGAQRRRVALLGVDDPEHNTQRRMLIPTFSVKRIGALRPRIQETVD
RLLDAMERQGPPAELVSAFALPVPSMVICALLGVPYADHAFFEERSQRLLRGPGADDVNRARDELEEYL
GALIDRKRAEPGDGLLDELIHRDHPDGPVDREQLVAFAVILLIAGHETTANMISLGTFTLLSHPEQLAALRA
GGTSTAVVVEELLRFLSIAEGLQRLATEDMEVDGATIRKGEGVVFSTSLINRDADVFPRAETLDWDRPAR
HHLAFGFGVHQCLGQNLARAELDIAMRTLFERLPGLRLAVPAHEIRHKPGDTIQGLLDLPVAW

CYP105E1 (from Rhodococcus fascians)      SEQ ID NO:140
mAGTADLPLEMRRNGLNPTEELAQVRDRDGVIPVGELYGAPAFLVCRYEDVRRIFADSNRFSNAHTPMF
AIPSGGDVIEDELAAMRAGNLIGLDPPDHTRLRHILAAEFSVHRLSRLQPRIAEIVDSALDGLEQAGQPADL
MDRYALPVSLLVLCELLGVPYADRDELRDRTARLLDLSASAEQRAVAQREDRRYMATLVTRAQEQPGDD
LLGILARKIGDNLSTDELISIISLIMLGGHETTASMIGLSVLALLHHPEQAAMMIEDPNCVNSGIEELLRWLSV
AHSQPPRMAVTEVQIAGVTIPAGSFVIPSLLAANRDSNLTDRPDDLDITRGVAGHLAFGHGVHFCLGHSLA
RMTLRTAVPAVLRRFPDLALSPSHDVRLRSASIVLGLEELQLTW

CYP105F1 (from Streptomyces lavendulae)      SEQ ID NO:141
mSDTEQHAPTLPRQRTCPFSPPPELEELRRTDPISRMRFADDSPGWLLTRHADVRAALADPGVSSHPGK
APQPWRNLAPEMRAEHYLPGFLIFMDPPDHTRYRRLLTKWFTMRAIRKLEPRIEQIVTETLDAMEAQGGT
VDLVQSFALPIPLLVICELMGIRYEEREEFMDMVLRLQALDATPEELGALGARMNEFMMKLAAAKRANPG
DDLLSHLAHDPDADPALTDLEIAGIGVLMLIAGHETSANMLGVGTYTLLENADQWALLRDDISLIDRAVEEL
LRHQTIVQQGLPRGVTRDMEIAGHQVKTGESLLASLPAANRDPAVFPDPDRLDITREHNPHLAFGHGIHL
CLGMELARVEMRQAWRGLVTRFPGLRMAAAPEDIRWRDDQIVYGVYNLPVTWDEAK

CYP105H1 (from Streptomyces noursei)      SEQ ID NO:142
mSTEADARTAAPQCPVAFPLRRPGRPFPPPEYATYRGGAGLVRSELPSGPVWLVTRHEDVRAVLTDPRI
SADPSKPGFPKAGRTGGAPSQYEVPGWFVAMDPPEHGRFRKTLIPEFTVRKVRELRPVIQQIVDERIDAM
LAAGTSADLVESFALPVPSLVISSLLGVPKVDRDFFEDRTRVLVRLSSTDEERDKATQALLRYLGRLIQIKQ
RRPGDDLISRLIAAGTLSRQELSGVAMLLLIAGHETTANNIGLGVVQLLTNPRWIGDDRIVEELLRYYSVAD
LVAFRVAVEDVEIGGQLIRAGEGIVPLIAAANHDATAFAAPSEFDPERSARSHVAFGYGVHQCLGQNLVRE
EMDIAYRTLFARIPSLTLAVPVEELPLKYDGVLFGLHELPVTWK

CYP105J1 (from Amycolatopsis mediterranei rifamycin)   SEQ ID NO:143
mTDAISFEVPWDRTDKFDPPAVFDSLREERPLAKMVYPDGHVGWIVSSYELVREVLSDLRFSHSCEVGH
FPVTHQGQVIPTHPLIPGMFIHMDPPEHTRYRKLLTGEFTVRRASRLIPRAEAVAAEQIEVMRAKGAPADV
VMDFAKPLVLRMLGELVGLPYEERDRYVPAVTLLHDAEADPAEAAAAYEVAGKFFDEVIERRRQRPQDDL
ISSLVTEDLTQEELRNIVTLLLFAGYETTEGALATGVFALLHHTDQLAALRAEPEKLDAAIEELLRYLTVNQY
HTYRTALEDVKLEGELIKKGDTVTVSLPAANRDPAKFGCPAELDIERDTSGHVAFGFGIHQCLGQNLARIE
LRAGFTALLRAFPELRLAVPADEVPLRLKGSVFSVKKLPVSW

FIG. 17-31

CYP105K1 (from Streptomyces tendae strain Tue901)       SEQ ID NO:144
mTETFGHDIPSFPMARECPMHPPAEYRKLRVQEPVSRVRMPDGQVAWLVLKHDLARKLLADPRVSADR
LHPAFPGRLTAEQRTATERVRRLSTRRSMIHLDGDEHGAHRKILTGEFSLRRIAALRPRVQEIVDRSIDEM
LAAPQPADLVEHVSQAVPSLVICELLGVPHEQRRDFHEWAGMLVSRSVSIRERAAASDALNDFLEDLVTE
KERGEPTDDLIGRLIARNRRTPVMTHDEIVGTAVMLLIAGHQTTANMISLGVVALLENPEHKARIAADPSLL
PPAIEEMLRYFSVVENAPARVATEDIEIGGVTIRKDEGIVVSGLAADWDDEVFEHPDRLDFERGARHHVAF
GYGVHQCLGQNLARVELEIVFETLLRRVPGLSLAVPAEELPYKDDAGIYGIYRVPVNC

CYP105L1 (from Streptomyces fradiae)       SEQ ID NO:145
mSSSGDARPSQKGILLPAARANDTDEAAGRRSIAWPVARTCPFSPPEQYAALRAEEPIARAELWDGAPV
WLISRQDHVRALLADPRVSIHPAKLPRLSPSDGEAEASRSLLTLDPPDHGALRGHFIPEFGLRRVRDVRPS
VEQIVTGLLDDLTARGDEADLLADFALPMATQVICRLLDIPYEDRDYFQERTEQATRPAAGEEALEALLELR
DYLDRLISGKTGRESGDGMLGSMVAQARGGGLSHADVLDNAVLLLAAGHETTASMVTMSVLVLLQHPTA
WRELTVNPGLLPGAVDELLRYLSIADGLRRSATADIEIDGHTIRAGDGLVFLLAAANRDEAVFSEPEAFDIH
RSARRHVAFGYGPHQCLGQNLARMELEVALGAVLERLPALRPTTDVAGLRLKSDSAVFGVYELPVAW

CYP105M1 (from Streptomyces clavuligerus clavulanic)   SEQ ID NO:146
mNEAAPQSDQVAPAYPMHRVCPVDPPPQLAGLRSQKAASRVTLWDGSQVWLVTSHAGARAVLGDRRF
TAVTSAPGFPMLTRTSQLVRANPESASFIRMDDPQHSRLRSMLTRDFLARRAEALRPAVRELLDEILGGL
VKGERPVDLVAGLTIPVPSRVITLLFGAGDDRREFIEDRSAVLIDRGYTPEQVAKARDELDGYLRELVEERI
ENPGTDLISRLVIDQVRPGHLRVEEMVPMCRLLLVAGHGTTTSQASLSLLSLLTDPELAGRLTEDPALLPK
AVEELLRFHSIVQNGLARAAVEDVQLDDVLIRAGEGVVLSLSAGNRDETVFPDPDRVDVDRDARRHLAFG
HGMHQCLGQWLARVELEEILAAVLRWMPGARLAVPFEELDFRHEVSSYGLGALPVTW

CYP105P1 (from Streptomyces avermitilis)       SEQ ID NO:147
mPEPTADAPTVPKARSCPFLPPDGIADIRAAAPVTRATFTSGHEAWLVTGYEEVRALLRDSSFSVQVPHA
LHTQDGVVTQKPGRGSLLWQDEPEHTSDRKLLAKEFTVRRMQALRPNIQRIVDEHLDAIEARGGPVDLVK
TFANAVPSMVISDLFGVPVERRAEFQDIAEAMMRVDQDAAATEAAGMRLGGLLYQLVQERRANPGDDLI
SALITTEDPDGVVDDMFLMNAAGTLLIAAHDTTACMIGLGTALLLDSPDQLALLREDPSLVGNAVEELLRYL
TIGQFGGERVATRDVELGGVRIAKGEQVVAHVLAADFDPAFVEEPERFDITRRPAPHLAFGFGAHQCIGQ
QLARIELQIVFETLFRRLPGLRLAKPVEELRFRHDMVFYGVHELPVTW

CYP105Q3 (from Streptomyces)       SEQ ID NO:148
mADTLTDAAPDTDGRVPEYPMPRATGCPLAPSPAAAELRGDRPITRVRIWNGSTPWLITRHADQRTLLTD
PRVSNDDHEPDFPHVNAHRAAIAPHTPKLITNTDAPEHTRLRRSVNAPFLVKRIEAMRPAVQKIVDDLIDD
MLAGPSPADLLTALALPVPSLVIAELLGVPYEDHHFFQENSNRVLDNSLTAEEAQESSRALGGYLDTLFRT
KLEQPGEDVLSEMGSKVKAGEMTHQEAVSMGVAMLIAGHETTATMISLGTLALFEHPDQLAVLRDTEDPK
VVAGAVDELLRYLSIVHSGLRRVAKGDIEIDGRLIRKGDGLLFDLQTANWDPNAFPGAERLDLARPARQHN
AFGYGPHQCLGQNLARLELQVVYGTLYRRVLTLRPAVPVDQLAFNHTGTTYGVKCLPVTW

CYP105Q6 (from Mycobacterium vanbaalenii)      SEQ ID NO:149
mTETLAQEAVSVPEYPMERTAGCPFAPPQQMLEMNQVKPLSRVRIWNGTTPWLVTGHEVARTLFADSR
VSVDDRREGFPHWNEHMLSTVDKRPRSVFTSDAEEHTRFRRMLSKPFTFRRVEALRPVIQQVTDECIDEI
LAGPQPADMVAKLALPVPTRVISDMLGVPYEDHEFFQEHANAGLARYAAADAMQKGAMSLHQYLINLVE
EKQAHPAEDAVSDLAERVTAGEISVKEAAQLGTGLLIAGHETTANMIGIGICALLENPEQAALLRDSDDPKF
IANAVEELMRYLSIIQNGQRRVATEDIEIGGETIRAGEGIILDLAPANWDARAFPEPDKLDLTRDATQQLGF
GYGRHQCVGQQLARAELQIVFHTLLRRIPTMKPAIPLEEVPFKHDRLAYGVYELPVTW

CYP105Q7 (from Mycobacterium smegmatis)      SEQ ID NO:150
mSETLTQPSATDIPGYPMERAAACPFAPPPQMLDMNKAKGLSRVRIWDGSTPWLITGHEEARALFADSR
VSVDDRRPGFPHWNEHMLATVHKRPRSVFTSDAEEHTRFRRMLSKPFTFRRVEGLRPAIQKITDECIDAIL
AGPQPADIVDKLALPVPTVVISEMLGVPYEDHEFFQEHANAGLARYAAADAMQKGAMSLHQYLIDLIEKKQ
AEPAEDAVSDLAERVTAGELSVKEAAQLGTGLLIAGHETTANMIGIGILALLENPEQADFLRNAEDPKVIAN
AVEELMRYLSIIQTGQRRVAVEDIEIGGETIKAGEGIIIDLVPANWDAKAFPEPDKLDLTRDAGQQLGFGYG
RHQCVGQQLARAELQIVFHTLLRRIPTLRLAIPLEEVPFKHDRLAYGVYELPVAW

FIG. 17-32

CYP105S1 (from Mycobacterium smegmatis)   SEQ ID NO:151
mTQAQALPPLHIRRDAFDPTPELGEIRAGEGVHVTVNPFGMQVYLVTRHEDVKTVLSDHERFSNSRPPG
FVLPGAPQISAEEQASNRAGNLLGLDPPEHQRLRRMLTPEFTIRRIKRLEPRIVEIVDAHLDAMESAGPPA
DIVADFALPIPSLVICELLGVPYEDRTDFQQRSARQLDLSAPMPERLELQRQGRAYMRGLVERSRTRPGD
DILGMLVREHGTELTDDELIGIAGLLLLAGHETTSNMLGLGVLALLRHPDQLACVRDDPDAVGPAIEELLR
WLSIVSTALPRITTTDVELAGVTIPAGHLVFASLPAGNRDPEFIDDPDTLDIRRGAPGHLAFGHGVHHCLGA
PLARMEMRIALPALLRRFPTLALAEPFEDVRWRPFHFIYGLQSLAVAW

FIG. 17-33

US 9,273,342 B2

METHODS AND SYSTEMS FOR EVALUATING AND PREDICTING THE REACTIVITY OF MONOOXYGENASE ENZYMES

CROSS-REFERENCE TO RELATED APPLICATIONS

This application is a national stage application under 35 U.S.C. §371 of PCT Application No. PCT/US2012/024723, filed Feb. 10, 2012, which claims priority to and the benefit of U.S. provisional patent application Ser. No. 61/441,948, entitled "Methods and systems for predicting the reactivity of monooxygenase enzymes," filed Feb. 11, 2011, which is incorporated herein by reference in its entirety.

STATEMENT REGARDING FEDERALLY SPONSORED RESEARCH OR DEVELOPMENT

Not applicable

1. TECHNICAL FIELD

The present invention relates to methods and systems for evaluating and predicting the reactivity of monooxygenase enzymes. The invention also relates to methods and systems for identifying monooxygenases and engineered variants thereof having desired reactivity properties or suitable for acquiring such properties.

2. BACKGROUND OF THE INVENTION

Catalytic methods for selective oxidation of carbon-hydrogen (C—H) bonds are of huge synthetic utility, as they can simplify the synthesis of complex molecules, providing more concise, atom-economical, and convenient routes for the preparation and derivatization of these compounds. In the context of bioactive molecules, for example, site-selective introduction of oxygenated functionalities at unreactive C—H positions can itself contribute to improve the physicochemical, pharmacokinetic or pharmacological properties of these compounds. Additionally, these transformations can facilitate further functional elaboration of these compounds through interconversion of the newly installed oxygenated functionalities into other functional groups in order to obtain more potent or bioavailable derivatives.

Selective oxidation of C—H bonds and in particular aliphatic C—H bonds is a difficult chemical transformation due to the chemical inertness of these bonds towards most chemical reagents, the abundance of C—H bonds in synthetic and naturally occurring molecules, and the higher reactivity of the oxidized products compared to the reagents, which can lead to undesired overoxidation reactions (Gunay, A.; Theopold, K. H. Chem. Rev., 2010, 110, 1060; Stahl, S. S.; Labinger, J. A.; Bercaw, J. E. Angew. Chem. Int. Ed. Engl., 1998, 37, 2181; Punniyamurthy, T.; Velusamy, S.; Iqbal, J. Chem. Rev., 2005, 105, 2329). This makes the development of efficient oxidation catalysts that possess sufficient chemical reactivity while maintaining high chemo-, regio-, and stereoselectivity a considerable challenge. Considerable effort has been devoted over the past decades towards the development of chemical methods for selective oxidation of aliphatic C—H bonds. These involve the use of oxidizing reagents (Brodsky, B. H.; Du Bois, J. J Am Chem Soc, 2005, 127, 15391; Wender, P. A.; Hilinski, M. K.; Mayweg, A. V. Org. Lett., 2005, 7, 79; Lee, S.; Fuchs, P. L. J Am Chem Soc, 2002, 124, 13978; Gomez, L.; Garcia-Bosch, I.; Company, A.; Benet-Buchholz, J.; Polo, A.; Sala, X.; Ribas, X. Angew. Chem. Int. Ed. Engl., 2009, 48, 5720; Chen, K.; Baran, P. S, Nature, 2009, 459, 824), supramolecular catalysts (Grieco, P. A.; Stuk, T. L. J Am Chem Soc, 1990, 112, 7799; Cook, B. R.; Reinert, T. J.; Suslick, K. S. J Am Chem Soc, 1986, 108, 7281; Yang, J.; Gabriele, B.; Belvedere, S.; Huang, Y.; Breslow, R. J. Org. Chem., 2002, 67, 5057; Das, S.; Incarvito, C. D.; Crabtree, R. H.; Brudvig, G. W. Science, 2006, 312, 1941; Das, S.; Brudvig, G. W.; Crabtree, R. H. Chem Commun, 2008, 413), biomimetic catalysts (Mahadevan, V.; Gebbink, R. J. M. K.; Stack, T. D. P. Curr. Opin. Chem. Biol., 2000, 4, 228; Que, L., Jr.; Tolman, W. B. Nature, 2008, 455, 333), and organometallic catalysts (Chen, M. S.; White, M. C. Science, 2007, 318, 783; Chen, M. S.; White, M. C. Science, 2010, 327, 566; Dick, A. R.; Hull, K. L.; Sanford, M. S. J Am Chem Soc, 2004, 126, 2300; Dick, A. R.; Sanford, M. S. Tetrahedron, 2006, 62, 2439). Despite this progress, these methods suffer from a number of drawbacks, such as having limited catalytic efficiency (i.e., low turnover numbers), requiring the presence of 'directing groups' pre-installed in the target molecule, and/or allowing selective targeting of only electronically activated (e.g., tertiary or heteroatom-bearing) C—H sites in the molecule of interest. Moreover, such oxidation reagents/catalysts are not readily amenable to modulation of the regio- and stereoselectivity in order to target different C—H sites in the same target molecule.

While selective oxyfunctionalization of organic molecules via chemical methods remains difficult, several enzymatic systems occur in nature that are able to carry out this transformation under mild reaction conditions such as ambient pressure and temperature and in aqueous solvents. Monooxygenases (EC 1.13 and EC 1.14) are an important class of enzymes that catalyze the insertion of a single oxygen atom from molecular oxygen ($O_2$) into the aliphatic or aromatic C—H bond of an organic substrate (Tones Pazmino, D. E.; Winkler, M.; Glieder, A.; Fraaije, M. W. Journal of biotechnology, 2010, 146, 9; Lewis, J. C.; Coelho, P. S.; Arnold, F. H. Chem Soc Rev, 2010). Monooxygenases are classified according to the enzyme-bound cofactor involved in oxygen activation and include heme-dependent, flavin-dependent, copper-dependent, non-heme iron-dependent, pterin-dependent, and cofactor-independent monooxygenases (Tones Pazmino, D. E.; Winkler, M.; Glieder, A.; Fraaije, M. W. Journal of biotechnology, 2010, 146, 9; Lewis, J. C.; Coelho, P. S.; Arnold, F. H. Chem Soc Rev, 2010).

Heme-dependent monooxygenases, also referred to as cytochrome P450 monooxygenases or CYPs are a large class of enzymes found in both eukaryotic and prokaryotic organisms, including bacteria, fungi, plants, insects, and mammals. Cytochrome P450 enzymes are defined by the presence of a heme (iron protoporphyrin IX) prosthetic group coordinated on the proximal side by a thiolate ion of a conserved cysteine residue (Denisov, I. G.; Makris, T. M.; Sligar, S. G.; Schlichting, I. Chem. Rev., 2005, 105, 2253; Ortiz de Montellano, P. R. Chem. Rev., 2010, 110, 932). The typical reaction catalyzed by P450 enzymes involves the reductive activation of molecular oxygen, using electrons equivalents derived from reduced pyridine nucleotides (NADH or NADPH), and subsequent insertion of one of the oxygen atoms into the substrate with concomitant reduction of the second oxygen atom to water (Denisov, I. G.; Makris, T. M.; Sligar, S. G.; Schlichting, I. Chem. Rev., 2005, 105, 2253; Ortiz de Montellano, P. R. Chem. Rev., 2010, 110, 932). Depending on the electron transport systems, cytochrome P450 enzymes have been divided in several classes (e.g., class I, class II, class III, class IV) albeit this way of classification have changed over time as new typologies of P450 systems have been discovered (Bernhardt, R. Journal of biotechnology, 2006, 124, 128). Cytochrome P450s can also operate as peroxidases utilizing hydrogen peroxide as oxidant species and the peroxide shunt pathway in the catalytic cycle without the need of a NAD(P) H-oxidizing redox partner (Denisov, I. G.; Makris, T. M.; Sligar, S. G.; Schlichting, I. Chem. Rev., 2005, 105, 2253). In addition to hydroxylation, P450 monooxygenases are also capable of catalyzing other reactions, including epoxidation, heteroatom (e.g., N, S, O) dealkylation, heteroatom (e.g., N, S) oxidation, oxidative deamination, dehydrogenation, dehydration, oxidative C—C bond cleavage, and rearrangements (Sono, M.; Roach, M. P.; Coulter, E. D.; Dawson, J. H. Chem. Rev., 1996, 96, 2841; Guengerich, F. P. Curr Drug Metab, 2001, 2, 93). More than 10,000 distinct members of the P450 family have been identified to date. Natural P450 enzymes are known to catalyze the oxidation of a wide range of structurally diverse substrates, including fatty acids, drugs, steroids, and numerous other natural products and small molecules. Despite their broad substrate and reaction scope and sequence identities as low as 20%, members of the P450 family share a conserved structural fold as revealed by comparison of the crystal structure of P450s isolated from bacterial, mammalian, and plant sources (Pylypenko, O.; Schlichting, I. Annual review of biochemistry, 2004, 73, 991; Graham, S. E.; Peterson, J. A. Arch. Biochem. Biophys., 1999, 369, 24).

Another class of synthetically and biotechnologically valuable monooxygenase enzymes are flavin-dependent monooxygenases (Tones Pazmino, D. E.; Winkler, M.; Glieder, A.; Fraaije, M. W. Journal of biotechnology, 2010, 146, 9; van Berkel, W. J. H.; Kamerbeek, N. M.; Fraaije, M. W. Journal of biotechnology, 2006, 124, 670). Flavin-dependent monooxygenases are able to catalyze numerous reactions, including C—H bond hydroxylations, epoxidations, Bayer-Villiger oxidations, and sulfoxidations (Tones Pazmino, D. E.; Winkler, M.; Glieder, A.; Fraaije, M. W. Journal of biotechnology, 2010, 146, 9; van Berkel, W. J. H.; Kamerbeek, N. M.; Fraaije, M. W. Journal of biotechnology, 2006, 124, 670). The flavins associated to these enzymes, either covalently or non-covalently, are either FMN or FAD. According to their amino acid similarities, members of the flavin-dependent monooxygenases family have been subdivided into six classes, namely A, B, C, D, E, and F (Tones Pazmino, D. E.; Winkler, M.; Glieder, A.; Fraaije, M. W. Journal of biotechnology, 2010, 146, 9; van Berkel, W. J. H.; Kamerbeek, N. M.; Fraaije, M. W. Journal of biotechnology, 2006, 124, 670). To perform the oxidation reactions, these enzymes generate a reactive intermediate upon reaction between molecular oxygen and the reduced enzyme-bound flavin. Depending on the protonation state, the reactive intermediate causes the monooxygenation of the substrate via a nucleophilic or an electrophilic mechanism. In most cases, reduction of the enzyme-bound flavin is achieved through oxidation of reduced coenzymes NADPH or NADH. Examples exist, however, where the flavin is reduced by the substrate itself.

The ability of monooxygenases to catalyze, among other reactions, the oxidation of aromatic and aliphatic C—H bonds with high catalytic efficiency and under mild reaction conditions makes them attractive platforms for the development of biocatalysts for selective oxidation of organic molecules (Fasan, R.; Chen, M. M.; Crook, N. C.; Arnold, F. H. Angew. Chem. Int. Ed. Engl., 2007, 46, 8414; Lewis, J. C.; Bastian, S.; Bennett, C. S.; Fu, Y.; Mitsuda, Y.; Chen, M. M.; Greenberg, W. A. Proc. Natl. Acad. Sci. USA, 2009, 106, 16550; Li, S.; Chaulagain, M. R.; Knauff, A. R.; Podust, L. M.; Montgomery, J.; Sherman, D. H. Proc. Natl. Acad. Sci. USA, 2009, 106, 18463; Whitehouse, C. J.; Bell, S. G.; Tufton, H. G.; Kenny, R. J.; Ogilvie, L. C.; Wong, L. L. Chem Commun, 2008, 966; Zehentgruber, D.; Hannemann, F.; Bleif, S.; Bernhardt, R.; Lutz, S. Chembiochem, 2010, 11, 713; Sun, L.; Chen, C. S.; Waxman, D. J.; Liu, H.; Halpert, J. R.; Kumar, S. Arch. Biochem. Biophys., 2007, 458, 167; Liu, L.; Schmid, R. D.; Urlacher, V. B. Biotechnol. Lett., 2010, 32, 841; Bottner, B.; Schrauber, H.; Bernhardt, R. J. Biol. Chem., 1996, 271, 8028; Peters, M. W.; Meinhold, P.; Glieder, A.; Arnold, F. H. J Am Chem Soc, 2003, 125, 13442; Tang, W. L.; Li, Z.; Zhao, H. Chem Commun, 2010, 46, 5461). In addition to being inherently 'green' and inexpensive to produce, these biological oxidation catalysts offers the advantage that their regio- and stereoselectivity can be modulated by protein engineering and potentially directed also towards energetically and/or stereoelectronically unactivated aliphatic and aromatic C—H bonds. Recently, the systematic utilization of P450 variants with diversified substrate profile and regioselectivity has constituted a powerful strategy towards the late-stage transformation of single and multiple unactivated $sp^3$ C—H bonds in small-molecule substrates through P450-mediated chemoenzymatic synthesis (Rentmeister, A.; Arnold, F. H.; Fasan, R. Nat Chem Biol, 2009, 5, 26).

While many different monooxygenases can be isolated from natural sources or produced by protein engineering, a bottleneck remains, namely the time and screening effort required to identify the variant(s) with the suitable level of catalytic activity (i.e., turnover number and turnover rate) and selectivity (i.e., chemo-, regio- and stereoselectivity) for the intended synthetic application. Typically, this requires the screening of large libraries of natural or engineered monooxygenases by GC- or HPLC-based methods, which are inherently low throughput and involve extensive sample manipulation. The use of fluoro/chromogenic substrate surrogates can accelerate this process (Fasan, R.; Chen, M. M.; Crook, N. C.; Arnold, F. H. Angew. Chem. Int. Ed. Engl., 2007, 46, 8414; Peters, M. W.; Meinhold, P.; Glieder, A.; Arnold, F. H. J Am Chem Soc, 2003, 125, 13442; Fasan, R.; Meharenna, Y. T.; Snow, C. D.; Poulos, T. L.; Arnold, F. H. J. Mol. Biol., 2008, 383, 1069; Schwaneberg, U.; Schmidt-Dannert, C.; Schmitt, J.; Schmid, R. D. Anal. Bioanal. Chem., 1999, 269, 359; Ghosal, A.; Hapangama, N.; Yuan, Y.; Lu, X.; Horne, D.; Patrick, J. E.; Zbaida, S. Biopharm. Drug. Dispos., 2003, 24, 375), but these methods are limited in scope in that they are useful only in the context of a single target substrate. Furthermore, none of the methods currently available for high throughput screening of monooxygenase activity (e.g., Rabe, K. S.; Gandubert, V. J.; Spengler, M.; Erkelenz, M.; Niemeyer, C. M. Anal. Bioanal. Chem., 2008, 392, 1059) provides qualitative or quantitative information, regarding the regio/stereoselectivity of the screened enzymes, which has to be established on a case-by-case basis through laborious and time-consuming HPLC or GC analyses.

Molecular modeling methods have been proposed for predicting substrate binding to monooxygenase enzymes such as, for example, P450 enzymes (Stjernschantz, E.; Oostenbrink, C. Biophys. J., 2010, 98, 2682; Harris, D. L.; Park, J. Y.; Gruenke, L.; Waskell, L. Proteins, 2004, 55, 895; Terfloth, L.; Bienfait, B.; Gasteiger, J. J. Chem. Inf. Model., 2007, 47, 1688; Vasanthanathan, P.; Olsen, L.; Jorgensen, F. S.; Vermeulen, N. P.; Oostenbrink, C. Drug Metab. Dispos., 2010, 38, 1347). However, the plasticity and dynamic nature of these enzymes hampers the formulation of accurate and reliable predictions (Hritz, J.; de Ruiter, A.; Oostenbrink, C. J. Med. Chem., 2008, 51, 7469; Ekroos, M.; Sjogren, T. Proc. Natl. Acad. Sci. USA, 2006, 103, 13682). In addition, these methods do not discriminate between inhibitors and substrates (Stjernschantz, E.; Oostenbrink, C. Biophys. J., 2010, 98, 2682; Vasanthanathan, P.; Olsen, L.; Jorgensen, F. S.; Vermeulen, N. P.; Oostenbrink, C. Drug Metab. Dispos., 2010, 38, 1347). Finally, these approaches require prior knowledge of the enzyme structure which may not be available or readily available, in particular when a multitude of different monooxygenases, either natural or engineered, are to be evaluated.

Citation or identification of any reference in Section 2, or in any other section of this application, shall not be considered an admission that such reference is available as prior art to the present invention.

3. SUMMARY OF THE INVENTION

A method is provided for acquiring a functional fingerprint (hereinafter "fingerprint") of a monooxygenase or a plurality of monooxygenases, the method comprising the steps of:
  providing a set of fingerprint probes comprising at least two fingerprint probes;
  providing a monooxygenase or a plurality of monooxygenases;
  contacting the monooxygenase or each member of the plurality of monooxygenases with each probe of the set of fingerprint probes;
  acquiring data, the data characterizing the activity of the monooxygenase or the activity of each member of the plurality of monooxygenases on each probe of the set of fingerprint probes; and
  generating a fingerprint of the monooxygenase or of each member of the plurality of monooxygenases, the generating step comprising the step of compiling the data characterizing the activity of the monooxygenase or the member of the plurality of monooxygenases on each probe of the set of fingerprint probes.

In one embodiment, at least one of the fingerprint probes of the set is an organic molecule of general formula:

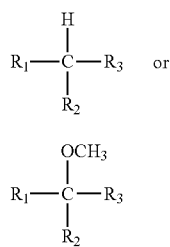

wherein $R_1$, $R_2$, and $R_3$ are independently selected from the group consisting of hydrogen, aliphatic, aryl, substituted aliphatic, substituted aryl, heteroatom-containing aliphatic, heteroatom-containing aryl, substituted heteroatom-containing aliphatic, substituted heteroatom-containing aryl, alkoxy, aryloxy, and functional groups (FG) or are taken together to form a ring, such that the carbon atom is a secondary or tertiary carbon atom.

In another embodiment, $R_1$, $R_2$, and $R_3$ are independently selected from the group consisting of hydrogen, $C_1$-$C_{24}$ alkyl, $C_1$-$C_{24}$ substituted alkyl, $C_1$-$C_{24}$ substituted heteroatom-containing alkyl, $C_1$-$C_{24}$ substituted heteroatom-containing alkyl, $C_2$-$C_{24}$ alkenyl, $C_2$-$C_{24}$ substituted alkenyl, $C_2$-$C_{24}$ substituted heteroatom-containing alkenyl, $C_2$-$C_{24}$ substituted heteroatom-containing alkenyl, $C_5$-$C_{24}$ aryl, $C_5$-$C_{24}$ substituted aryl, $C_5$-$C_{24}$ substituted heteroatom-containing aryl, $C_5$-$C_{24}$ substituted heteroatom-containing aryl, $C_1$-$C_{24}$ alkoxy, $C_5$-$C_{24}$ aryloxy groups.

In another embodiment, $R_1$ comprises a chemical structure selected from the group consisting of $C_3$-$C_{20}$ cycloalkane, decalin, adamantane, norbornane, bicyclo[2.2.2]octane, bicyclo[3.2.1]octane, bicyclo[3.1.1]heptanes, spiro[5.5]undecane, spiro[4.5]decane, octahydro-1H-indene, decahydroazulene, decahydro-1H-benzo[7]annulene, octahydro-1H-3a,7-methanoazulene, decahydro-1H-cyclopenta[a]pentalene, tetradecahydrophenanthrene, dodecahydro-1H-cyclopenta[a]naphthalene, dodecahydro-1H-fluorene, tetradecahydroanthracene, cembrane, tetradecahydro-6,10-methanobenzo[10]annulene, hexadecahydro-1H-cyclopenta[a]phenanthrene, gonane, docosahydropicene, icosahydro-1H-cyclopenta[a]chrysene, benzene, napthene, anthracene, pyrrole, furan, thiophene, azolidine, oxolane, thiolane, imidazolidine, pyrazolidine, imidazole, imidazoline, pyrazole, pyrazoline, oxazolidine, isoxazolidine, oxazole, oxazoline, isoxazole, isoxazoline, thiazolidine, isothiazolidine, thiazole, thiazoline, isothiazole, isothiazoline, dioxolane, oxathiolane, dithiolane, dithiazole, furazan, oxadiazole, thiadiazole, tetrazole, piperidine, pyridine, tetrahydropyran, pyran, thiane, thiopyran, piperazine, diazines, morpholine, oxazine, thiazine, dithiane, dioxane, dioxin, triazine, trioxane, tetrazine, azepane, azepine, oxepane, oxepine, thiepane, thiepine, diazepine, thiazepine, azetidine, oxetane, thietane, pyrrolidine, tetrahydrofuran, tetrahydrothiophene, pyrrole, furan, thiophene, piperidine, tetrahydropyran, thiane, pyridine, azepane, oxepane, thiepane, azepine, oxepine, thiepine, indole, isoindole, quinoline, isoquinoline, benzofurane, benzothiophene, benzazepine, and derivatives of these chemical structures wherein at least one hydrogen atom is substituted with a non-hydrogen atom.

In another embodiment, at least one of the fingerprint probes of the set is a naturally occurring terpene or a derivative of a naturally occurring terpene, wherein at least one hydrogen atom is substituted with a non-hydrogen atom.

In another embodiment, at least one of the fingerprint probes is selected from the group consisting of hemiterpene, monoterpene, sesquiterpene, diterpene, sesterterpene, triterpene, tetraterpene, polyterpene, substituted hemiterpene, substituted monoterpene, substituted sesquiterpene, substituted diterpene, substituted sesterterpene, substituted triterpene, substituted tetraterpene, substituted polyterpene.

In another embodiment, the monooxygenase or at least one member of the plurality of monooxygenases is an enzyme that can catalyze the insertion of an oxygen atom into a chemical bond or an atom.

In another embodiment, the monooxygenase or the at least one member of the plurality of monooxygenases catalyze the insertion of an oxygen atom into a chemical bond or an atom using an oxygen source selected from the group consisting of molecular oxygen, hydrogen peroxide, and peroxyacid and salts thereof.

In another embodiment, the monooxygenase or the at least one member of the plurality of monooxygenases is selected from the group consisting of heme-dependent, flavin-dependent, copper-dependent, non-heme iron-dependent, pterin-dependent, and cofactor-independent monooxygenases.

In another embodiment, the monooxygenase or the at least one member of the plurality of monooxygenases is a heme-dependent monooxygenase.

In another embodiment, the heme-dependent monooxygenase is a P450 monooxygenase.

In another embodiment, the P450 monooxygenase is a naturally occurring P450 monooxygenase or an engineered variant of a naturally occurring P450 monooxygenase.

In another embodiment, the P450 monooxygenase is selected from the group consisting of SEQ ID NOs 1-151, and variants thereof.

In another embodiment, the monooxygenase is a flavin-dependent monooxygenase.

In another embodiment, the flavin-dependent monooxygenase is a naturally occurring flavin-dependent monooxygenase or an engineered variant thereof.

In another embodiment, the flavin-dependent monooxygenase is selected from the group consisting of 4-hydroxybenzoate 3-monooxygenase (EC 1.14.13.2), 2-hydroxybiphenyl 3-monooxygenase (EC 1.14.13.44), phenol 2-monooxygenase, salicylate 1-monooxygenase (EC 1.14.13.1), hydroxybiphenyl 3-monooxygenase, cyclohexanone monooxygenase (EC 1.14.13.22), 4-hydroxyacetophenone monooxygenase (EC 1.14.13.84), cyclopentanone monooxygenase (EC 1.14.13.16), phenylacetone monooxygenase, 4-hydroxyphenylacetate 3-monooxygenase (EC 1.14.13.3), 4-nitrophenol monooxygenase, 2,4,5-trichlorophenol monooxygenase, styrene monooxygenase, and variants thereof.

In another embodiment, the monooxygenase is comprised in a cell or a cell lysate, or in isolated purified form.

A method is also provided for identifying at least one monooxygenase that can accept a target molecule as substrate for oxygenation comprising the steps of:
  providing a monooxygenase library, wherein the library comprises a plurality of monooxygenases and wherein each member of the plurality of monooxygenases of the library is associated with a functional fingerprint, wherein the fingerprint is acquired according to the steps of the method disclosed herein;
  measuring the degree of molecular similarity between the target molecule and each probe of a set of fingerprint probes used to acquire a fingerprint of the monooxygenases;
  identifying the fingerprint probe of the set with the highest degree of molecular similarity to the target molecule;
  ranking the members of the plurality of monooxygenases of the library according to the value of the fingerprint component corresponding to the fingerprint probe with highest degree of molecular similarity to the target molecule; and
  isolating monooxygenases from the library of fingerprinted monooxygenases according to order of ranking.

In one embodiment, top-ranking monooxygenases are isolated. For example, top-ranked monooxygenases can be ranked in the top 1-5%, 5-10%, 10-15%, 15-20%, etc. according to the value of the fingerprint component corresponding to the fingerprint probe with highest degree of molecular similarity to the target molecule.

In another embodiment, the degree of molecular similarity between the fingerprint probes and the target molecule is measured using a set-, graph-, vector-, or function-based algorithm.

In another embodiment, the degree of molecular similarity between the fingerprint probes and the target molecule is measured with an algorithm that utilizes a maximal common substructure index, a Hellinger distance index, a Tanimoto index, a 3D shape descriptor index, a Carbó similarity index, a Hodgkin similarity index, a Petke similarity index, or a distance-based similarity index.

In another embodiment, the algorithm is a maximal common substructure algorithm.

A method is also provided for identifying at least one monooxygenase in a library of monooxygenases (hereinafter "monooxygenase library") that exhibits at least one different reactivity property than a target monooxygenase, the method comprising the steps of:
  acquiring a fingerprint for the target monooxygenase and for each member of a the monooxygenase library according to the methods disclosed herein;
  comparing the fingerprints with that of the target monooxygenase; and
  isolating at least one monooxygenase whose fingerprint exhibits a significant deviation in at least one of the fingerprint components as compared to that of the target monooxygenase.

In one embodiment, the fingerprints of the monooxygenase library are normalized to that of the target monooxygenase and wherein those monooxygenases whose normalized fingerprint exhibits a significant deviation from the unit in at least one of the fingerprint components are isolated.

A method is also provided for identifying a monooxygenase (or a plurality of monooxygenases) from a monooxygenase library that exhibits similar reactivity properties compared to a target monooxygenase, the method comprising the steps of:
  acquiring a fingerprint for the target monooxygenase and for each member of the monooxygenase library according to the method disclosed herein;
  comparing the fingerprints with that of the target monooxygenase; and
  isolating the monooxygenase (or a plurality of monooxygenases) whose fingerprint does not deviate significantly, in any of its components, from that of the target monooxygenase.

In one embodiment, the fingerprints of the monooxygenase library are normalized to that of the target monooxygenase and wherein those monooxygenases whose normalized fingerprint do not exhibit a significant deviation from the unit in any of its components.

A method is also provided for identifying, within a library of fingerprinted monooxygenases, monooxygenases that exhibit a particular reactivity property, the method comprising
  isolating a subset of fingerprinted monooxygenases from the monooxygenase library to serve as training set;
  collecting data characterizing the reactivity property for each monooxygenase of the training set;
  correlating the training set fingerprints with the reactivity property data to generate a fingerprint-reactivity property model that is predictive of the reactivity property as a function of the fingerprint;
  ranking the members of the monooxygenase library using the fingerprint-reactivity property model; and
  isolating monooxygenases from the library of fingerprinted monooxygenases according to order of ranking.

In one embodiment, the reactivity property is a substrate-reactivity property corresponding to the ability of the monooxygenase to accept a target molecule as substrate for oxygenation.

In another embodiment, the reactivity property is a site-reactivity property corresponding to the ability of the monooxygenase to catalyze the oxygenation of a particular chemical bond or atom in a target molecule.

In another embodiment, the fingerprint-reactivity property model is obtained using a multiple linear regression, a principal component regression, a partial least squares regression, or a multiple non-linear regression technique.

In another embodiment, the fingerprint-reactivity property model is obtained using a support vector machines technique.

A method is also provided for assessing the ability of a mutagenesis event to generate monooxygenases with diversified reactivity properties, the method comprising the steps of:
provided a mutagenesis event and a parent monooxygenase;
subjecting the parent monooxygenase to the mutagenesis event so that a library of daughter monooxygenases is produced;
acquiring a fingerprint for each member of the daughter monooxygenase library according to the method of claim 1; and
measuring the quantity of monooxygenases having a unique fingerprint, wherein a unique fingerprint is a fingerprint that deviates significantly, in at least one of its components, from that of the parent monooxygenase and any other member of the library.

In one embodiment, the mutagenesis event is selected from the group consisting of site-directed mutagenesis, site-saturation mutagenesis, random mutagenesis, recombination, and unnatural amino acid mutagenesis of one or more amino acid positions of the parent monooxygenase.

A method is also provided for defining a mutagenesis scheme to generate libraries of monooxygenase variants having diversified reactivity properties, this method comprising the steps of:
providing a set of mutagenesis events and a parent monooxygenase;
assessing the functional diversity-generating potential of each mutagenesis event according a the method for assessing the ability of a mutagenisis event to generate monooxygenases with diversified reactivity properties, the method comprising the steps of:
a. providing a mutagenesis event and a parent monooxygenase;
b. subjecting the parent monooxygenase to the mutagenesis event so that a library of daughter monooxygenases is produced;
c. acquiring a fingerprint for each member of the daughter monooxygenase library according to the method of claim 1; and
d. measuring the quantity of monooxygenases having a unique fingerprint, wherein a unique fingerprint is a fingerprint that deviates significantly, in at least one of its components, from that of the parent monooxygenase and any other member of the library;
ranking the mutagenesis events according to their functional diversity-generating potential; and
defining a mutagenesis scheme according to the order of ranking for the mutagenesis events.

In one embodiment, the mutagenesis event is selected from the group comprising site-directed mutagenesis, site-saturation mutagenesis, random mutagenesis, recombination, unnatural amino acid mutagenesis of one or more amino acid positions of the parent monooxygenase.

In another embodiment, the mutagenesis scheme combines one or more mutagenesis events within 10%, 30%, 50%, and 80% of the order of ranking.

In another embodiment, the mutagenesis scheme is used to produce a daughter library of monooxygenase variants using the parent monooxygenase as parent.

In another embodiment, the mutagenesis scheme is used to produce a daughter library of monooxygenase variants using a monooxygenase as parent, wherein this monooxygenase is different than the parent monooxygenase.

In another embodiment, the mutagenesis scheme is used to produce a daughter library of monooxygenase variants using a monooxygenase as parent, wherein this monooxygenase shares at least 15% amino acid sequence homology to the parent monooxygenase.

In another embodiment of any of the methods disclosed herein, the monooxygenase is a P450 monooxygenase.

In another embodiment of any of the methods disclosed herein, the P450 monooxygenase is a P450 monooxygenase selected from the group consisting of SEQ ID NOs 1-151.

4. BRIEF DESCRIPTION OF THE DRAWINGS

The present invention is described herein with reference to the accompanying drawings, in which similar reference characters denote similar elements throughout the several views. It is to be understood that in some instances, various aspects of the invention may be shown exaggerated or enlarged to facilitate an understanding of the invention.

Figure 1:
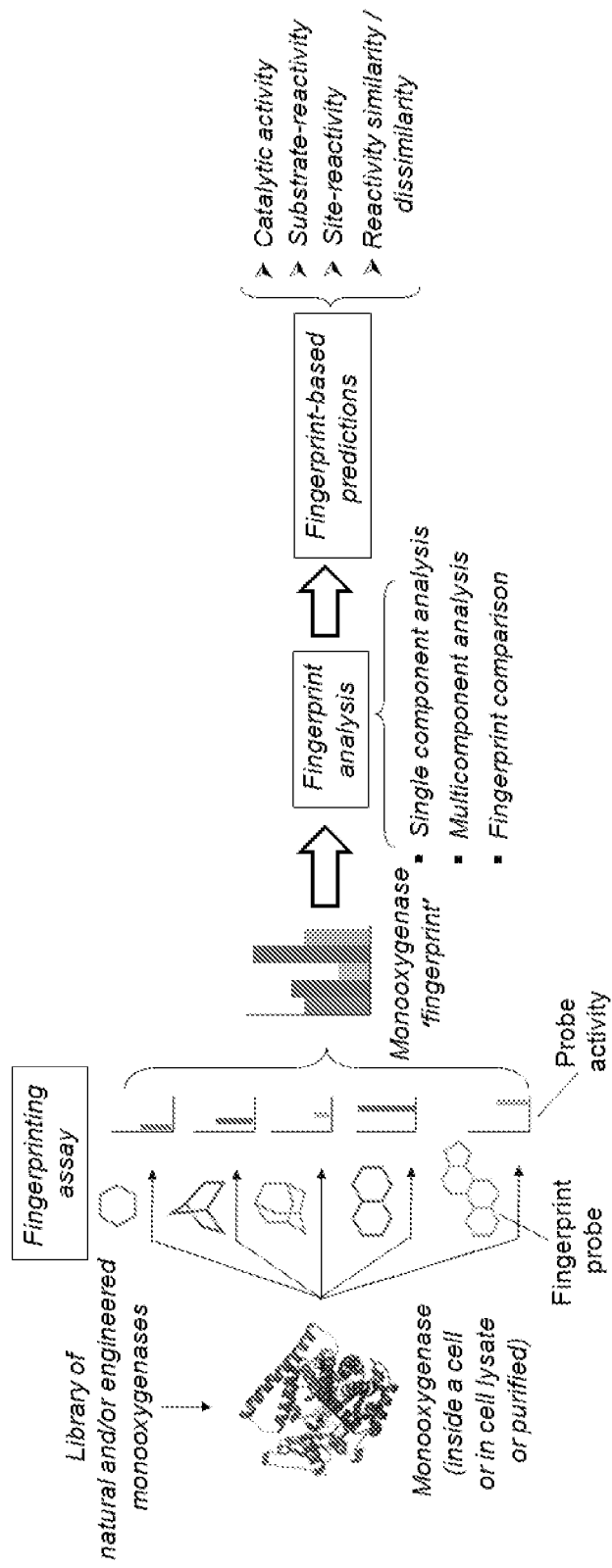

FIG. 1 schematically illustrates the process of acquiring a fingerprint of a monooxygenase and analyzing the fingerprint to predict the reactivity properties of the enzyme.

FIGS. 2A-B. (A) Fingerprint probes (fingerprint probe set 1) (B) Fingerprints of a library of monooxygenases comprising CYP102A1 and nine engineered variants thereof acquired using the compounds of fingerprint probe set 1 as probes and probe-induced NADPH oxidation rate as a measure of probe activity.

FIGS. 3A-B. (A) Fingerprint probes (fingerprint probe set 2) (B) Fingerprint profiles of a library of monooxygenases comprising CYP102A1 and nine engineered variants thereof acquired using the compounds of fingerprint probe set 2 as probes and probe-induced NADPH oxidation rate as a measure of probe activity.

FIGS. 4A-C. (A) Set of five methoxy-containing fingerprint probes incorporating cyclohexane (1), norbornane (2), adamantane (3), decaline (4), and steroid (5) scaffolds. (B) Synthetic route to probe 4. (C) Synthetic route to probe 5.

FIGS. 5A-B. (A). Fingerprints of a library of monooxygenases comprising CYP102A1 and ten engineered variants thereof acquired using compounds I-5 as probes and demethylation activity (i.e. formaldehyde formation) as a measure of probe activity. (B) Fingerprints of CYP102A1 (=WT), FL#62, and 25 FL#62-derived variants from the pool of engineered monooxygenase exhibiting a unique profile. Probe activities are normalized to those of the reference enzyme FL#41. Mean values and standard deviations were calculated from three replicates.

Figure 6:
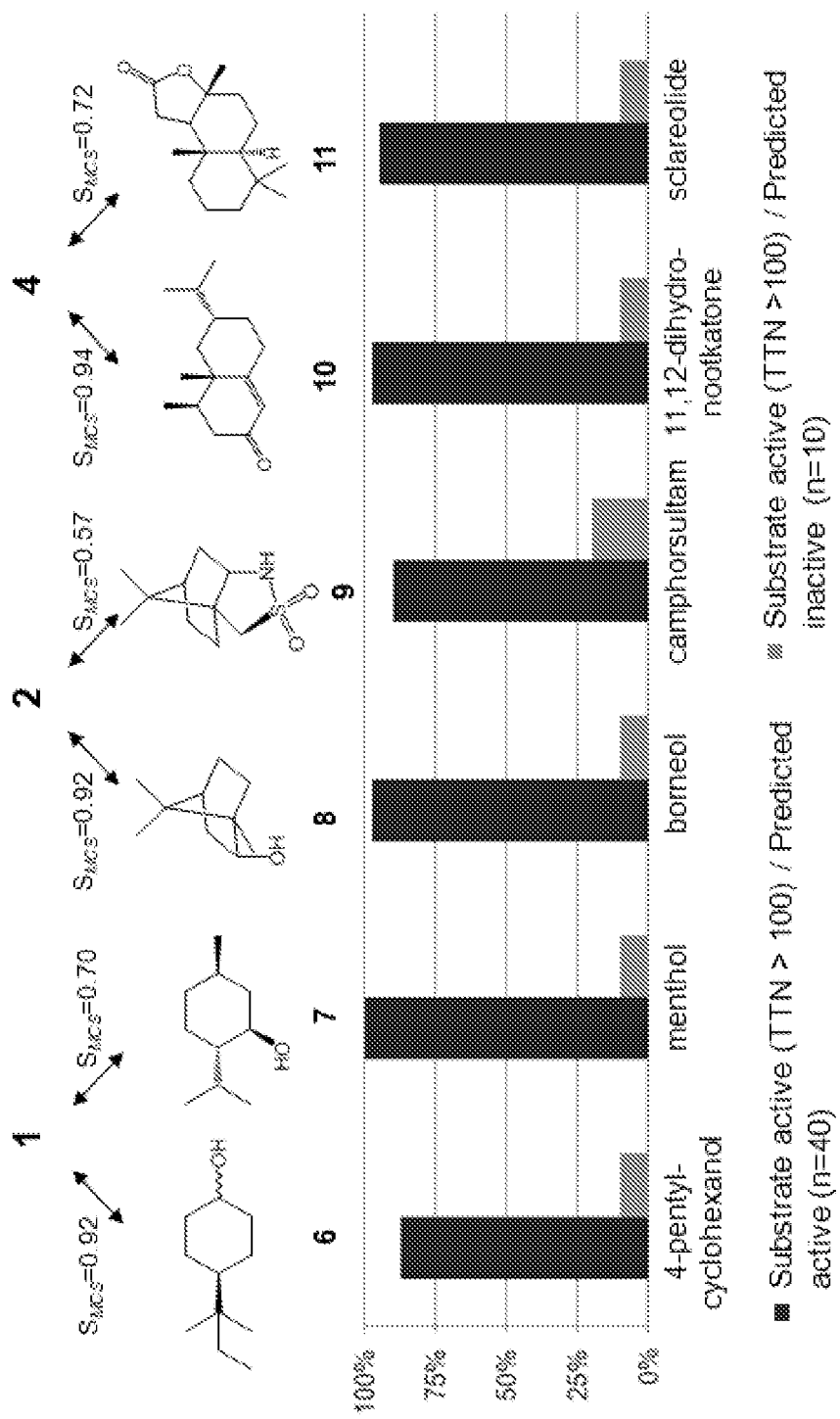

FIG. 6. Fraction of catalytically active P450 variants on target compounds 6-11 (threshold activity: TTN>100) among the predicted active (black) and predicted inactive (grey) members of the P450 collection based on single fingerprint component analysis and probe-target substrate molecular similarity assessments. Sample size (n): 40 and 10 monooxygenases, respectively. The Maximal Common Substructure similarity indexes ($S_{MCS}$) for the target substrates versus fingerprint probes are indicated. $S_{MCS}$ ranges from 1 (max. molecular similarity) to 0 (no molecular similarity).

FIGS. 7A-B. (A) Product distribution (GC trace), total turnovers (TTN), fingerprints, and amino acid mutations (versus parent enzyme FL#62) of 8-active variants extracted from the collection of P450 monooxygenases with a unique fingerprint. (B) Product distribution of the enzymes as calculated from the integration of the GC traces provided in panel (A). Structures for the oxygenation products 12-16 are provided in FIG. 10.

FIGS. 8A-B. (A) Product distribution (GC trace), total turnovers (TTN), fingerprints, and amino acid mutations (versus parent enzyme FL#62) of 9-active variants extracted from the collection of P450 monooxygenases with a unique fingerprint. (B) Product distribution of the enzymes as calculated from the integration of the GC traces provided in panel (A). Structures for the oxygenation product 17 is provided in FIG. 10. Oxidation products a and b were not characterized.

Figure 9:
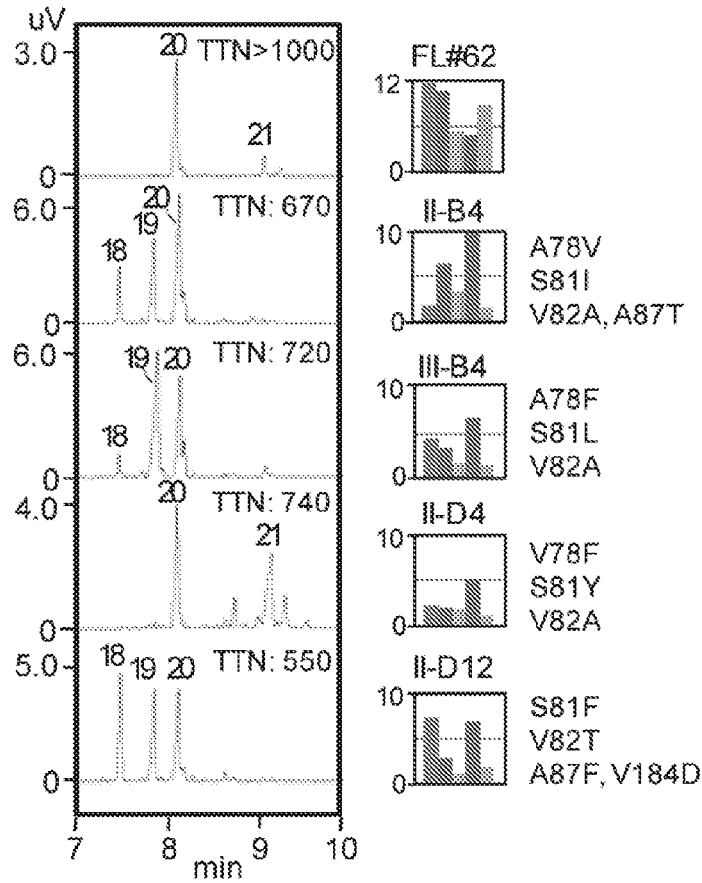

FIGS. 9A-B. (A) Product distribution (GC trace), total turnovers (TTN), fingerprints, and amino acid mutations (versus parent enzyme FL#62) of 10-active variants extracted from the collection of P450 monooxygenases with a unique fingerprint. (B) Product distribution of the enzymes as calculated from the integration of the GC traces provided in panel (A). Structures for the oxygenation products 18-21 are provided in FIG. 10.

Figure 10:
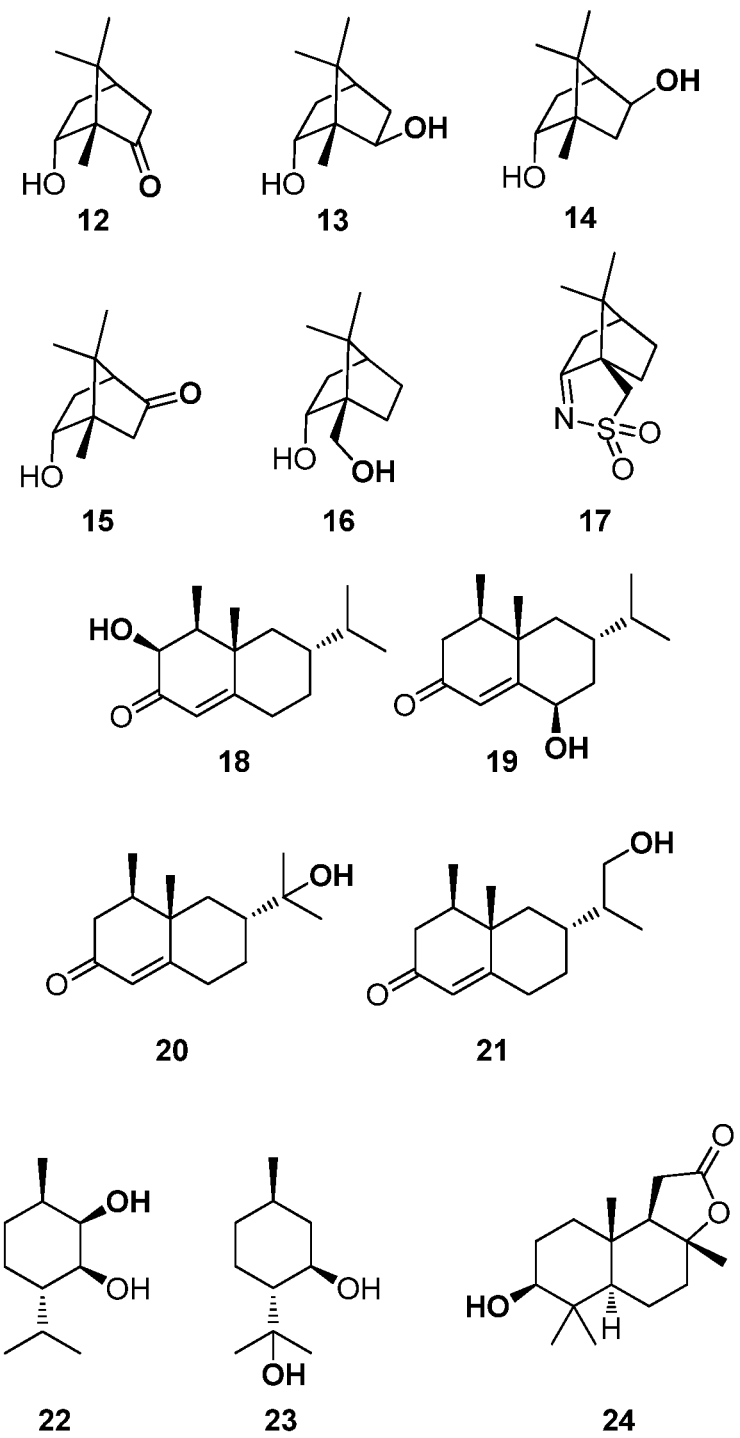

FIG. 10. Oxidation products isolated from the reactions with 8, 9, 10, and 7.

Figure 11:
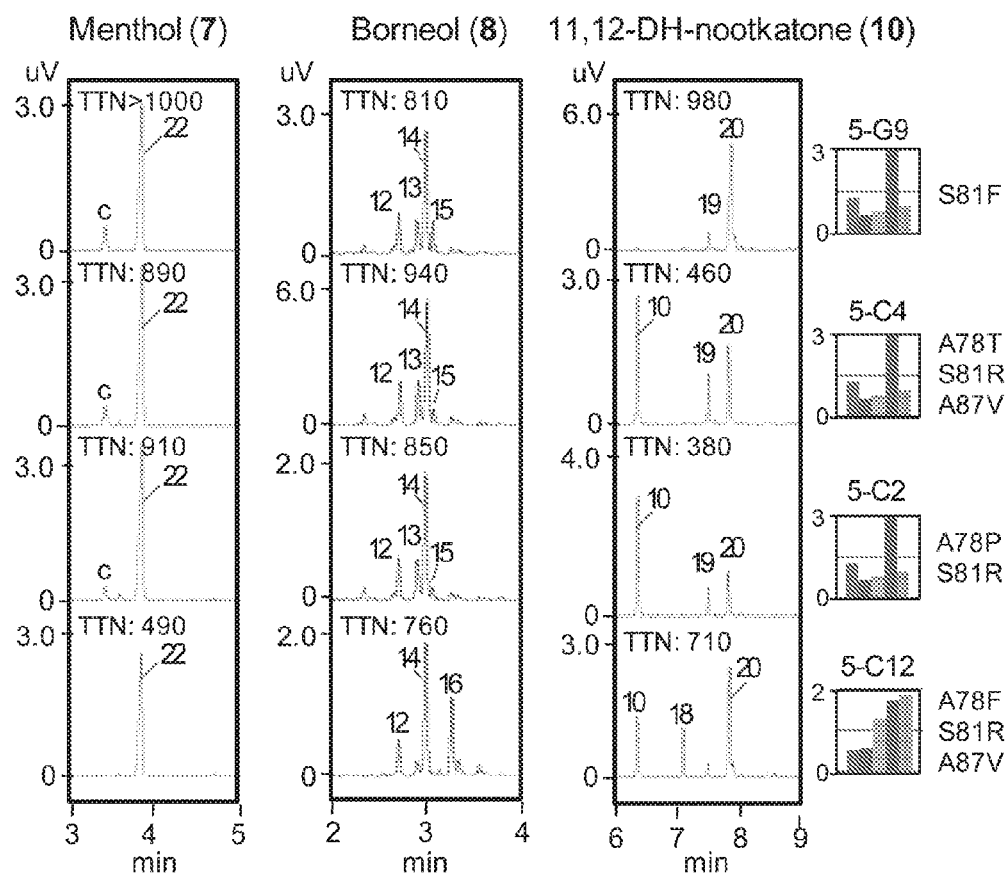

FIG. 11. Product distribution (GC trace), total turnovers (TTN), fingerprints, and amino acid mutations (versus parent enzyme FL#62) of three engineered FL#62-derived variants sharing an identical fingerprint and one (=negative control) having a different fingerprint from the same mutagenesis library (78/81/87NNK library). Structures for the oxygenation products 12-16, 18-20, and 22 are provided in FIG. 10. Oxidation product c was not characterized.

FIG. 12. Product distribution for the reactions of FIG. 11 as calculated from the integration of the corresponding GC traces. Product distribution of P450 variants 5-G9,5-C4, 5-C2, and 5-C12 in the oxidation of 7, 8, and 10 are shown. Structures for the oxygenation products 12-16, 18-20, and 22 are provided in FIG. 10.

Figure 13:
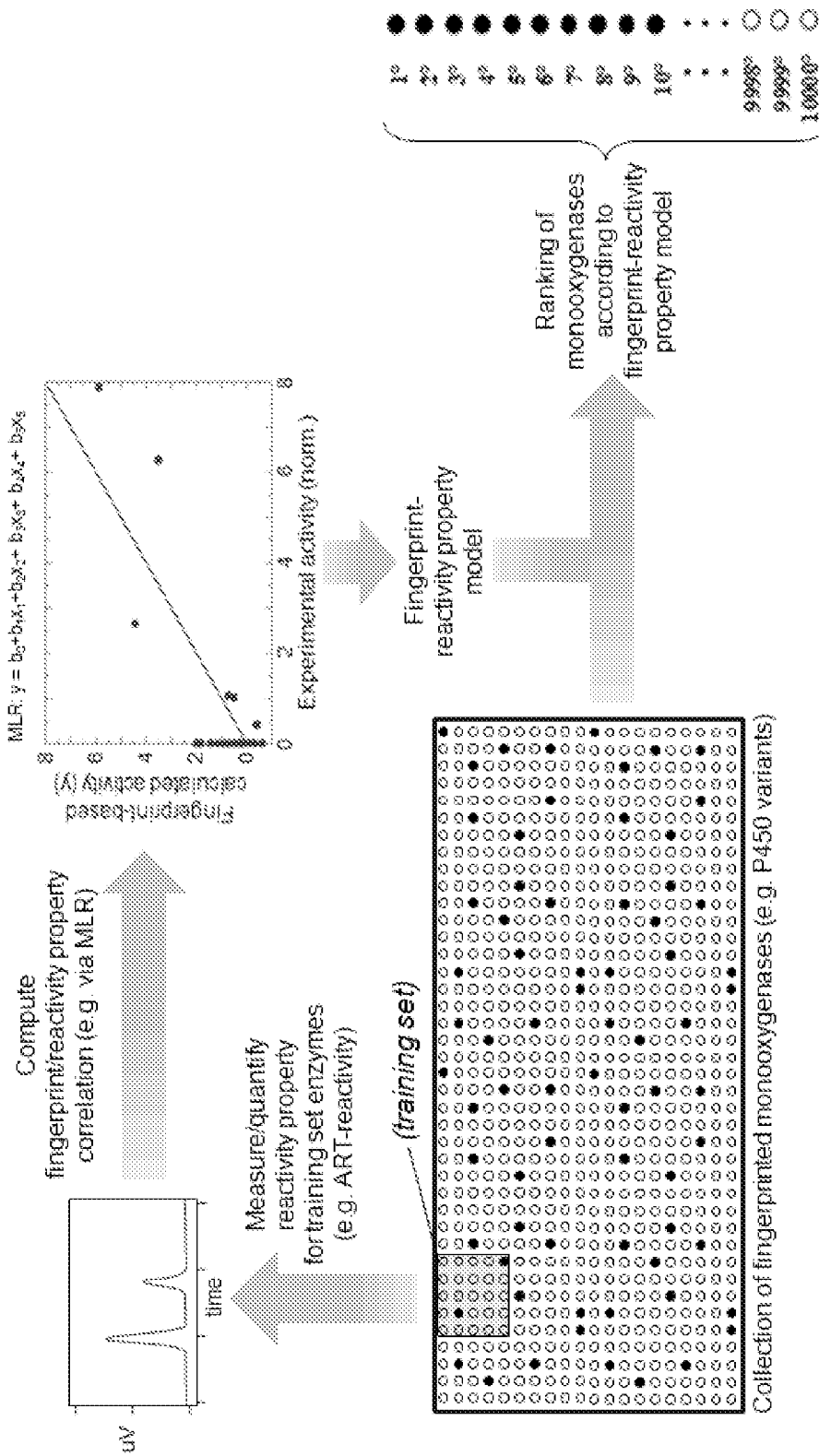

FIG. 13. Schematic illustration of the process for generating a fingerprint-based model predictive of a reactivity property of interest using a monooxygenase training set and for ranking the members of a collection of fingerprinted monooxygenase using the fingerprint-reactivity property model.

FIGS. 14A-B. (A) Chemical structure of artemisinin (ART) and of the three artemisinin hydroxylation products. (B) Total turnover numbers for ART hydroxylation for FL#62 and the 50 top-ranking FL#62-derived variants isolated according to the method illustrated in FIG. 13.

Figure 15:
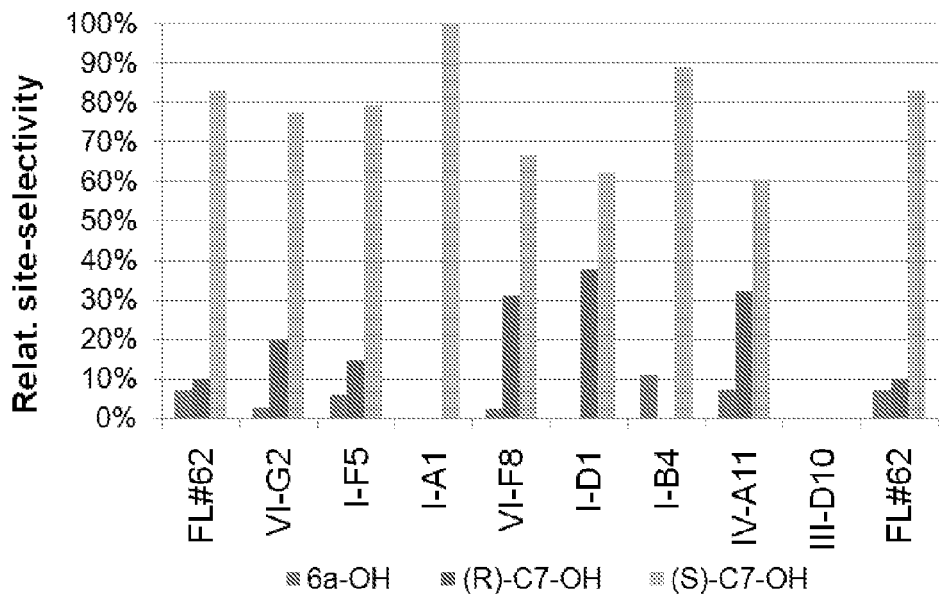

FIG. 15. Site-selectivity in artemisinin (ART) hydroxylation for 10 top-ranking P450 variants isolated according to the methods of fingerprint-based trained prediction of site-reactivity (see Example 6).

Figure 16:
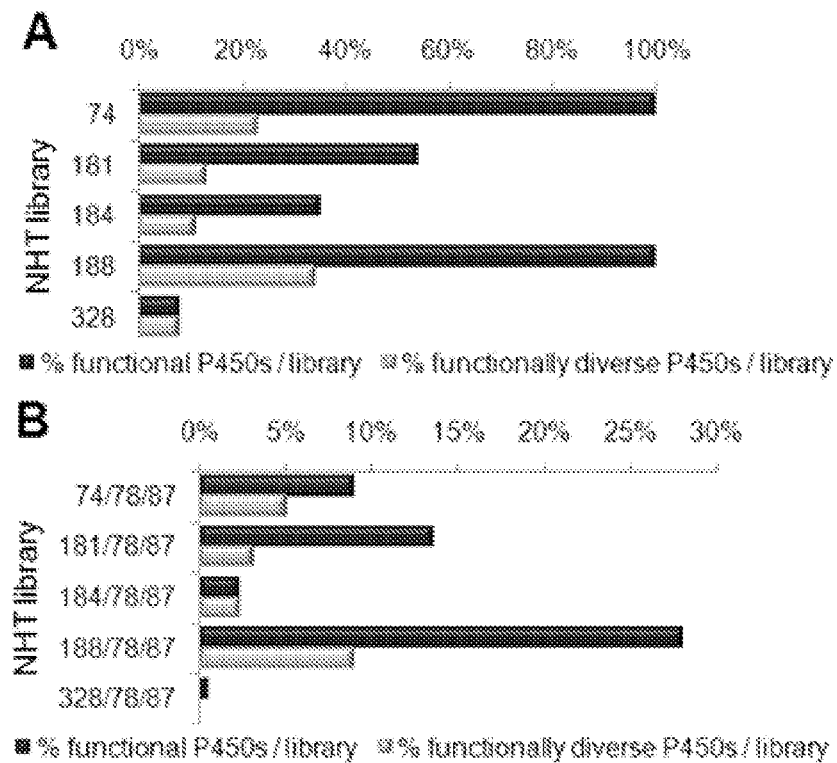

FIGS. 16A-B. (A) Functional diversity content (i.e. fraction of monooxygenase variants with a unique fingerprint) in various single-mutant site-saturation (NNK) monooxygenase daughter libraries derived from FL#62 (=parent monooxygenase). The fraction of functional variants in the library is also indicated. (B) Functional diversity content in second-generation monooxygenase daughter libraries (triple-mutant site-saturation (NNK) library) derived from FL#62 (=parent monooxygenase). The fraction of functional variants in the library is also indicated. and triple mutant libraries.

FIGS. 17-1 to 17-33. SEQ ID NOs. 1-151. FIG. 17. Name, organism of origin, and amino acid sequence of P450 monooxygenases. The corresponding SEQ ID number is indicated.

5. DETAILED DESCRIPTION OF THE INVENTION

Methods are provided that accelerate the discovery of monooxygenase oxidation catalysts with desired levels of catalytic activity and chemo-, regio- and stereoselectivity toward a compound of interest. These methods and systems can greatly accelerate the search for, discovery of, and engineering of monooxygenases with desired "reactivity properties." Such reactivity properties can include, for example, the ability of the monooxygenase to accept a given organic molecule as a substrate for oxygenation. In this case, the reactivity property is referred to herein as "substrate-reactivity", and when used in the context of a specific organic molecule, Z, it is referred to as "substrate-reactivity toward molecule Z". A monooxygenase that accepts an organic molecule as a substrate for oxygenation indicates that the monooxygenase is able catalyze the oxygenation of at least one chemical bond or atom in such a molecule and for more than one catalytic turnover.

The "reactivity properties" as defined herein with reference to a monooxygenase also can include the ability of the monooxygenase to catalyze the oxygenation of a particular chemical bond (e.g., a C—H bond or a carbon-carbon double bond) or an atom (e.g., a nitrogen or sulfur atom) in a given organic molecule. In this case, the reactivity property is referred to as "site-reactivity" or "site-selectivity". Depending on the context, and according to their conventional use in the art, such site-selectivity in the monooxygenase-catalyzed oxygenation reaction is referred to as "chemoselectivity," "regioselectivity," and/or "stereoselectivity."

Thus, according to the definitions provided above, the reactivity properties of a monooxygenase comprise both "substrate-reactivity" and "site-reactivity" in the context of one or more organic molecules. Since such organic molecules correspond to organic molecules whose chemical functionalization by the action of the monooxygenase is desired, they are also referred to herein as "target molecules" or "target compounds".

Methods are also provided for acquiring a functional profile of a monooxygenase enzyme, also referred to herein as "fingerprint" or "functional fingerprint", using a set of structurally different compounds, also referred to herein as "fingerprint probes" or simply "probes". Methods are also provided to generate predictions regarding the reactivity properties of fingerprinted monooxygenases through analysis of their fingerprint. As described in more detail below, these fingerprint-based methods for monooxygenase reactivity predictions can also involve comparison of the molecular similarity between the target compound and the fingerprint probes, the use of training sets of monooxygenases (trained predictions), or fingerprint comparative analyses. Furthermore, methods are provided which involve fingerprint analysis to guide the construction of engineered monooxygenase libraries containing members with diversified reactivity properties.

The conceptual basis underlying the methods disclosed here is that the monooxygenase fingerprints acquired according to methods described herein encode information regarding the active site configuration (i.e., size, shape, and geometry) of the fingerprinted enzymes. Since the active site configuration dictates the accessibility of the monooxygenase active site to a given molecule, it also dictates the ability of such monooxygenase to accept such a molecule as a substrate for oxygenation. Furthermore, as the monooxygenase active site configuration dictates the orientation of an enzyme-bound substrate with respect to the catalytic center of the enzyme, it also dictates the site-selectivity of the enzyme-catalyzed oxygenation on such molecule. Accordingly, the monooxygenase fingerprints acquired according to methods provided herein can be analyzed with the purpose of generating predictions regarding the substrate-reactivity and site-reactivity properties of the monooxygenase toward one or more target compounds of interest. According to the methods provided herein, the target compound of interest can be either structurally related or structurally unrelated to the fingerprint probes.

A schematic representation of one embodiment of a method provided herein is shown in FIG. 1. This embodiment comprises the step of using a set of fingerprint probes to acquire a functional fingerprint of a monooxygenase enzyme. Whenever the fingerprint probe set is designed to include different molecular scaffolds, the acquired monooxygenase fingerprint encodes information regarding the active site size, shape, and geometry of the fingerprinted enzyme. The fingerprint is subsequently analyzed to formulate predictions regarding the substrate-reactivity and site-reactivity of the fingerprinted enzyme toward a target compound of interest and/or whether the fingerprinted enzyme exhibits similar or dissimilar reactivity properties as compared to another monooxygenase whose fingerprint (obtained with the same fingerprint probe set) is known. In another embodiment, the number of monooxygenase variants exhibiting a unique fingerprint obtained through a particular mutagenesis event in a parental enzyme sequence is used to estimate the degree of diversity in reactivity properties associated to such mutagenesis event. In another embodiment, suitable mutagenesis events can be selected and/or combined with the purpose of constructing engineered libraries of monooxygenases containing members with diversified reactivity.

Compared to current techniques known in the art for screening and/or predicting the function of monooxygenase enzymes, the methods provided herein are based on a radically different concept and strategy (i.e., empirical mapping of the monooxygenase active site configuration via probes followed by 'decoding' of the fingerprint-encoded information toward prediction of monooxygenase reactivity) and they offer several and notable advantages, as illustrated in the Examples.

First, these methods can be applied to predict both the substrate-reactivity and site-reactivity properties of a fingerprinted monooxygenase toward a variety of structurally diverse target compounds simultaneously (i.e., broad target molecule scope).

Second, these methods can be readily applied to predict the reactivity of large libraries of monooxygenases such as those derived from collections of natural monooxygenases or libraries of engineered monooxygenases. In some embodiments, the fingerprinting procedure is amenable to throughput screening, which further accelerates the process of profiling and predicting the reactivity of monooxygenases from large enzyme libraries.

Third, the methods for monooxygenase reactivity prediction disclosed herein do not require prior knowledge of the structure of the monooxygenase to be evaluated or calculation of a structural model of such monooxygenase. They also do not require prior knowledge of the primary sequence of such monooxygenase.

Fourth, the methods disclosed herein enable a drastic reduction of the screening efforts and time required to identify a monooxygenase-based oxidation catalyst with the desired level of catalytic activity and/or regio- or stereoselectivity toward a target compound of interest. A related advantage is a drastic reduction of the amount of target substrate consumed during this process, which is of particular relevance when such target substrate is expensive or available in only limited amounts as it is case, for example, of many biologically active natural products.

Fifth, the methods disclosed herein enable the rapid identification of different monooxygenase-based oxidation catalysts for the oxidation of distinct sites (i.e., a C—H bond, a C=C double bond, or a heteroatom) in a target compound. In turn, this makes possible the chemical functionalization of the enzymatically installed oxygenated functionality in order to rapidly acquire structure-activity data on a target compound of interest (e.g., a biologically active complex natural product). As such, the methods disclosed herein can be useful toward the rapid optimization of the biological and/or pharmacological activities of a target compound, bypassing the need for developing lengthy and often difficult synthetic routes to obtain such derivatives.

For clarity of disclosure, and not by way of limitation, the detailed description of the invention is divided into the subsections set forth below.

5.1 Definitions

The present invention is not limited to particular chemical structures, monooxygenase sequences, compositions, algorithms, or systems, which can, of course vary. The terminology used herein is for the purpose of describing particular embodiments only, and it is not intended to be limiting. The following definitions set forth hereinbelow, and throughout the Detailed Description of the Invention and Examples, supplement those definitions known to persons of skill in the art.

The term "aliphatic" is used in the conventional sense to refer to an open-chain or cyclic, linear or branched, saturated or unsaturated hydrocarbon group, including but not limited to alkyl group, alkenyl group and alkynyl groups.

The term "heteroatom-containing aliphatic" as used herein refers to an aliphatic moiety where at least one carbon atom is replaced with a heteroatom.

The terms "alkyl" or "alkyl group" as used herein refer to a linear, branched, or cyclic saturated hydrocarbon typically containing 1 to 24 carbon atoms such as methyl, ethyl, n-propyl, isopropyl, n-butyl, isobutyl, t-butyl, octyl, decyl and the like.

The term "heteroatom-containing alkyl" as used herein refers to an alkyl moiety where at least one carbon atom is replaced with a heteroatom, e.g., oxygen, nitrogen, sulphur, selenium, phosphorus, or silicon, and typically oxygen, nitrogen, or sulphur.

The terms "alkenyl" or "alkenyl group" as used herein refer to a linear, branched, or cyclic hydrocarbon group of 2 to 24 carbon atoms containing at least one double bond, such as ethenyl, n-propenyl, isopropenyl, n-butenyl, isobutenyl, octenyl, decenyl, and the like.

The term "heteroatom-containing alkenyl" as used herein refer to an alkenyl moiety where at least one carbon atom is replaced with a heteroatom.

The term "alkynyl" or "alkynyl group" as used herein refers to a linear, branched, or cyclic hydrocarbon group of 2 to 24 carbon atoms containing at least one triple bond, such as ethynyl, n-propynyl, and the like.

The term "heteroatom-containing alkynyl" as used herein refer to an alkynyl moiety where at least one carbon atom is replaced with a heteroatom.

The terms "aryl" or "aryl group" as used herein refer to an aromatic substituent comprising a single aromatic or multiple aromatic rings that are fused together, directly linked, or indirectly linked (such as linked through a methylene or an ethylene moiety). Preferred aryl groups contain 5 to 24 carbon atoms.

The term "heteroatom-containing aryl" as used herein refer to an aryl moiety where at least one carbon atom is replaced with a heteroatom.

The term "alkoxy" or "alkoxy group" as used herein refers to an aliphatic group or a heteroatom-containing aliphatic group bound through a single, terminal ether linkage. Preferred aryl alkoxy groups contain 1 to 24 carbon atoms.

The term "aryloxy" or "aryloxy group" as used herein refers to an aryl group or a heteroatom-containing aryl group bound through a single, terminal ether linkage. Preferred aryloxy groups contain 5 to 24 carbon atoms.

The terms "halo" or "halogen" are used in the conventional sense to refer to a fluoro, chloro, bromo or iodo substituent.

The term "substituted" is used to indicate that in the alkyl, alkenyl, alkynyl, aryl, or other moiety, at least one hydrogen atom is replaced with at least one non-hydrogen atom. Examples of such substituents include, but are not limited to, functional groups referred to herein as "FG", such as alkyl, heteroatom-containing alkyl, alkenyl, heteroatom-containing alkenyl, alkynyl, heteroatom-containing alkynyl, aryl, heteroatom-containing aryl, alkoxy, heteroatom-containing alkoxy, aryloxy, heteroatom-containing aryloxy, halo, hydroxyl (—OH), sulfhydryl (—SH), substituted sulfhydryl, carbonyl (—CO—), thiocarbonyl, (—CS—), carboxy (—COOH), amino (—NH$_2$), substituted amino, nitro (—NO$_2$), nitroso (—NO), sulfo (—SO$_2$—OH), cyano (—C≡N), cyanato (—O—C≡N), thiocyanato (—S—C≡N), formyl (—CO—H), thioformyl (—CS—H), phosphono (—P(O)OH2), substituted phosphono, and phospho (—PO$_2$).

The term "contact" as used herein with reference to interactions of chemical units indicates that the chemical units are at a distance that allows short range non-covalent interactions (such as Van der Waals forces, hydrogen bonding, hydrophobic interactions, electrostatic interactions, dipole-dipole interactions) to dominate the interaction of the chemical units. For example, when a monooxygenase is 'contacted' with a chemical species, the monooxygenase is allowed to interact with the chemical species so that a reaction between the protein and the chemical species can occur.

The term "nucleic acid molecule" as used herein refers to any chain of two or more nucleotides (e.g., A, C, T, U, G) bonded in sequence.

The term "peptide", "polypeptide", and "protein" as used herein refers to any chain of two or more amino acids bonded in sequence, regardless of length or post-translational modification (e.g., glycosylation). Typically, a polypeptide contains at least 30 amino acid residues. The term "enzyme" as used herein refers to a protein that possesses the ability to catalyze a chemical reaction. The term "monooxygenase" as used herein refers to an enzyme that possesses the ability to catalyze an oxygenation reaction and, specifically, a monooxygenation reaction. A "monooxygenation reaction" is a chemical reaction by which an oxygen atom is inserted into a chemical bond or added to an atom. Examples of monooxygenation reactions include, for example, hydroxylation (i.e., an oxygen atom is added to a C—H bond), epoxidation (i.e., an oxygen atom is added to carbon-carbon double bond), N- or S-oxidation (i.e., an oxygen atom is added to nitrogen or sulfur atom). As described in Section 2 (Background) above, monooxygenases include heme-dependent, flavin-dependent, copper-dependent, non-heme iron-dependent, pterin-dependent, and cofactor-independent monooxygenases.

The terms "variant" as used herein with reference to a polypeptide such as an enzyme, and specifically a monooxygenase enzyme, indicates a derivative of such polypeptide, enzyme, or monooxygenase enzyme which has been manipulated resulting in a change in the amino acid composition of the polypeptide, wherein the manipulation includes but is not limited to mutating an amino acid residue to a different one, deleting or inserting one or more amino acid residues within the polypeptide sequence, or modifying one or more amino acid residues of the polypeptide via chemical, enzymatic, or other means. The term "parent" or "parental sequence" as used herein with reference to a polypeptide indicates the polypeptide from which a "variant" is derived, typically, after one manipulation step (e.g., one round of mutagenesis). The term "engineer" with reference to a polypeptide such as an enzyme, and specifically a monooxygenase enzyme, indicates any manipulation that result in a change in the amino acid composition of the polypeptide, wherein the manipulation includes but is not limited to mutating an amino acid residue to a different one, deleting or inserting one or more amino acid residues within the polypeptide sequence, or modifying one or more amino acid residues of the polypeptide via chemical, enzymatic, or other means.

The term "reactivity" as used herein with reference to a monooxygenase refers to the ability of a monooxygenase to catalyze a chemical reaction when contacted with another entity, such as, for example, an organic molecule.

The terms "target compound" or "target molecule" as used herein refer to an organic molecule of molecular weight comprised between 15 and 3,000 gram mol$^{-1}$ (i.e., between 15 and 3,000 Dalton). The chemical structure of the target compound can vary widely, provided that its molecular weight falls within the 15 to 3,000 Dalton range.

5.2 Methods for Acquiring a Functional Fingerprint of a Monooxygenase

A method for acquiring a functional fingerprint of a monooxygenase is provided. The method comprises the steps of (i) providing a set of fingerprint probes, (ii) expressing a monooxygenase using a nucleic acid molecule that encodes for this monooxygenase and a suitable expression system; (iii) contacting the expressed monooxygenase with each one of the fingerprint probes in parallel; (iv) measuring the activity of the monooxygenase on each of the fingerprint probes; and (v) generating a functional fingerprint of the monooxygenase by compiling the measured activity on each one of the probes.

In another embodiment, a method is provided for acquiring the functional fingerprint of a library of monooxygenases, this method comprising the steps of (i) providing a set of fingerprint probes, (ii) expressing a library of monooxygenases using nucleic acid molecules that encode for a plurality of monooxygenases, a suitable expression system, and a suitable multi-compartment apparatus, wherein each member of the library is contained in an isolated compartment, (iii) contacting each member of the monooxygenase library with each one of the fingerprint probes in parallel, (iv) measuring the activity of member of the monooxygenase library on each one of the fingerprint probes; and (v) generating a functional fingerprint for each monooxygenase of the library by compiling the measured activity on each one of the probes.

According to the methods disclosed herein, the fingerprint probe can be an organic molecule that comprises at least one carbon-hydrogen (C—H). In some embodiments, the fingerprint probe is an organic molecule of general formula (I):

wherein $R_1$, $R_2$, and $R_3$ are independently selected from the group consisting of hydrogen, aliphatic, aryl, substituted aliphatic, substituted aryl, heteroatom-containing aliphatic, heteroatom-containing aryl, substituted heteroatom-containing aliphatic, substituted heteroatom-containing aryl, alkoxy, aryloxy, and functional groups (FG) or are taken together to form a ring, such that the carbon atom is a secondary or tertiary carbon atom. Preferably, substituents $R_1$, $R_2$ and $R_3$ of formula I are independently selected from hydrogen, $C_1$-$C_{24}$ alkyl, $C_1$-$C_{24}$ substituted alkyl, $C_1$-$C_{24}$ substituted heteroatom-containing alkyl, $C_1$-$C_{24}$ substituted heteroatom-containing alkyl, $C_2$-$C_{24}$ alkenyl, $C_2$-$C_{24}$ substituted alkenyl, $C_2$-$C_{24}$ substituted heteroatom-containing alkenyl, $C_2$-$C_{24}$ substituted heteroatom-containing alkenyl, $C_5$-$C_{24}$ aryl, $C_5$-$C_{24}$ substituted aryl, $C_5$-$C_{24}$ substituted heteroatom-containing aryl, $C_5$-$C_{24}$ substituted heteroatom-containing aryl, $C_1$-$C_{24}$ alkoxy, $C_5$-$C_{24}$ aryloxy, carbonyl, thiocarbonyl, or carboxy. Most preferably, $R_1$, $R_2$ and $R_3$ of formula (I) can be independently selected from hydrogen, $C_1$-$C_{12}$ alkyl, $C_1$-$C_{12}$ substituted alkyl, $C_1$-$C_{12}$ substituted heteroatom-containing alkyl, $C_1$-$C_{12}$ substituted heteroatom-containing alkyl, $C_2$-$C_{12}$ alkenyl, $C_2$-$C_{12}$ substituted alkenyl, $C_2$-$C_{12}$ substituted heteroatom-containing alkenyl, $C_2$-$C_{12}$ substituted heteroatom-containing alkenyl, $C_5$-$C_{14}$ aryl, $C_5$-$C_{14}$ substituted aryl, $C_5$-$C_{14}$ substituted heteroatom-containing aryl, $C_5$-$C_{14}$ substituted heteroatom-containing aryl, $C_2$-$C_{14}$ alkoxy, $C_5$-$C_{14}$ aryloxy, carbonyl, thiocarbonyl, orcarboxy.

Example 1 demonstrates that the fingerprint probe can be an organic molecule of general formula I.

In preferred embodiments, the fingerprint probe is an organic molecule of general formula I, wherein $R_1$ comprises a chemical structure chosen from the group consisting of cyclopropane, cyclobutane, cyclobutene, cyclopentane, cyclopentene, cyclohexane, cyclohexene, cycloheptane, cycloheptene, cyclooctane, cyclooctene, cyclononane, cyclononene, cyclodecane, cyclodecene, cycloundecane, cycloundecene, cyclododecane, cyclododecene, cyclotridecane, cyclotridecene, cyclotetradecane, cyclotetradecene decalin, adamantane, norbornane, bicyclo[2.2.2]octane, bicyclo[3.2.1]octane, bicyclo[3.1.1]heptanes, spiro[5.5]undecane, spiro[4.5]decane, octahydro-1H-indene, decahydroazulene, decahydro-1H-benzo[7]annulene, octahydro-1H-3a,7-methanoazulene, decahydro-1H-cyclopenta[a]pentalene, tetradecahydrophenanthrene, dodecahydro-1H-cyclopenta[a]naphthalene, dodecahydro-1H-fluorene, tetradecahydroanthracene, cembrane, tetradecahydro-6,10-methanobenzo[10]annulene, hexadecahydro-1H-cyclopenta[a]phenanthrene, gonane, docosahydropicene, icosahydro-1H-cyclopenta[a]chrysene, benzene, napthene, anthracene, pyrrole, furan, thiophene, azolidine, oxolane, thiolane, imidazolidine, pyrazolidine, imidazole, imidazoline, pyrazole, pyrazoline, oxazolidine, isoxazolidine, oxazole, oxazoline, isoxazole, isoxazoline, thiazolidine, isothiazolidine, thiazole, thiazoline, isothiazole, isothiazoline, dioxolane, oxathiolane, dithiolane, dithiazole, furazan, oxadiazole, thiadiazole, tetrazole, piperidine, pyridine, tetrahydropyran, pyran, thiane, thiopyran, piperazine, diazines, morpholine, oxazine, thiazine, dithiane, dioxane, dioxin, triazine, trioxane, tetrazine, azepane, azepine, oxepane, oxepine, thiepane, thiepine, diazepine, thiazepine, azetidine, oxetane, thietane, pyrrolidine, tetrahydrofuran, tetrahydrothiophene, pyrrole, furan, thiophene, piperidine, tetrahydropyran, thiane, pyridine, azepane, oxepane, thiepane, azepine, oxepine, thiepine, indole, isoindole, quinoline, isoquinoline, benzofurane, benzothiophene, and benzazepine. Each of the chemical structures mentioned above can be substituted at one or more positions. "Substituted" means that in the alkyl, alkenyl, alkynyl, aryl, or other moiety occurring in this compound, at least one hydrogen atom is replaced with at least one non-hydrogen atom.

In other embodiments, the fingerprint probe is a naturally occurring molecule or a molecule derived from a naturally occurring molecule. A preferred group of naturally occurring molecules that can be used as fingerprint probes or that can be used to prepare fingerprint probes are members of the terpene family. The term "terpene", "isoprenoid", and "terpenoid" as used herein refers to a natural compound biosynthesized from isopentenyl pyrophosphate. Terpenes that can be used as fingerprint probes or that can be chemically modified to obtain fingerprint probes include, but are not limited to, hemiterpenes, monoterpenes, sesquiterpenes, diterpenes, sesterterpenes, triterpenes, tetraterpenes, and polyterpenes. Semisynthetic terpenes, that is, terpenes that have been chemically modified so that a non-naturally occurring functional group is introduced in the molecule can also be used as fingerprint probes. This embodiment is illustrated in Example 1 and 2.

Various methods can be applied for measuring the activity of a monooxygenase on a given fingerprint probe, also referred herein as "probe activity" or "fingerprint probe activity", to acquire a monooxygenase fingerprint. Such probe activity can be measured by measuring the decrease of the amount of probe, the accumulation of an oxygenation product derived from the probe (e.g., hydroxylated product), or the accumulation of an oxidation byproduct generated during the enzymatic reaction (e.g., formaldehyde from methoxy-containing probes or $H_2O_2$), after a given time after contacting the probe with the monooxygenase under suitable reaction conditions. Other methods to measure the probe activity include measuring the consumption of a cofactor (e.g., NADPH or NADH) or cosubstrate ($O_2$) utilized by the enzyme during the oxidation reaction. The choice of the method will vary depending on the specific application such as, for example, according to the nature of the fingerprint probe, the nature of the monooxygenase (e.g., its NAD(P)H cofactor specificity), and the size of the library of monooxygenases. A person skilled in the art will be capable of selecting the most appropriate method in each case.

Depending on the specific application and the method used for measuring the probe activity, the probe activity can be measured and expressed in terms of turnover number, product formation rate, cofactor consumption rate, $O_2$ consumption rate, $H_2O_2$ consumption rate (e.g., for $H_2O_2$-dependent monooxygenases), and the like.

One preferred method for measuring the probe activity is via spectrophotometric measurement of either NADPH or NADH oxidation after contacting the monooxygenase with the fingerprint probe under suitable reaction conditions. The nicotinamide cofactor (NADPH or NADH) is chosen according to the cofactor specificity of the monooxygenase enzyme and the cognate reductase protein. In this case, an increase in absorbance at 340 nm is indicative of NAD(P)H cofactor oxidation, which in turn is indicative of probe oxidation catalyzed by the monooxygenase. This embodiment is illustrated in Example 1.

Using other methods, the probe activity can be measured by measuring oxygen ($O_2$) consumption, which is consumed by the monooxygenase during the oxidation reaction. Techniques to measure the consumption of dissolved oxygen in a reaction vessel are known in the art, and include using oxygen-mediated quenching of a ruthenium dye. In this case, a decrease in the concentration of oxygen can be used as an indication of probe oxidation by the monooxygenase. In other variations of the method, probe activity can be measured by measuring the consumption of alternative oxygen donors such as hydrogen peroxide ($H_2O_2$) or organic peroxides. Probe activity can be measuring by analyzing the depletion of these cosubstrates after contacting the monooxygenase with the fingerprint probe. Reactive oxygen species (ROS, e.g., superoxide, hydrogen peroxide, and hydroxyl radicals), which are produced in the monooxygenase-catalyzed oxidation reaction, can also be used to measure probe activity after contacting the monooxygenase with the fingerprint probe.

In preferred embodiments, at least one of the fingerprint probes carries at least one reporter functional group. A "reporter functional group" refers to a group of atoms that, upon oxidation by action of the monooxygenase, can release a chromophore or a fluorophore or release a chemical species which can be detected spectrophotometrically through reaction with a reagent or a group of reagents. This embodiment is illustrated in Example 2.

In one embodiment, a preferred reporter functional group can be a methoxy group (—$OCH_3$). A methoxy group can be installed in an organic molecule to generate a fingerprint probe by chemical methods well known in the art. Alternatively, a synthetic molecule or a naturally occurring molecule comprising one or more methoxy groups can be utilized directly as a fingerprint probe. The activity of a monooxygenase on a fingerprint probe comprising at least one methoxy groups can be determined using a colorimetric reagent specific for formaldehyde. Since formaldehyde is formed as a result of monooxygenase-dependent oxidation of the methoxy group occurring in the fingerprint probe, detection of the produced formaldehyde can provide a direct measurement of the monooxygenases activity on a given probe. Various colorimetric reagents are known in the art for colorimetric detection and quantification of formaldehyde such as, for example, Nash reagent (ammonia plus acetylacetone), Purpald (4-amino-3-hydrazino-5-mercapto-1,2,4-triazole), and N-methylbenzothiazolinone-2-hydrazone (MBTH). For example, monooxygenase activity on fingerprint probes carrying a methoxy reporter functional group can be measured by detecting formaldehyde formation via addition of Purpald under alkaline conditions and measuring purple color development (absorbance at 550 nm) using a spectrophotometer. This embodiment is illustrated in Example 2.

In some embodiments, the fingerprint probe is an organic compound of general formula:

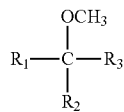

(II)

wherein $R_1$, $R_2$, and $R_3$ are independently selected from the group consisting of hydrogen, aliphatic, aryl, substituted aliphatic, substituted aryl, heteroatom-containing aliphatic, heteroatom-containing aryl, substituted heteroatom-containing aliphatic, substituted heteroatom-containing aryl, alkoxy, aryloxy, and functional groups (FG) or are taken together to form a ring, such that the carbon atom is a secondary or tertiary carbon atom. Preferably, substituents $R_1$, $R_2$ and $R_3$ of formula I are independently selected from hydrogen, $C_1$-$C_{24}$ alkyl, $C_1$-$C_{24}$ substituted alkyl, $C_1$-$C_{24}$ substituted heteroatom-containing alkyl, $C_1$-$C_{24}$ substituted heteroatom-containing alkyl, $C_2$-$C_{24}$ alkenyl, $C_2$-$C_{24}$ substituted alkenyl, $C_2$-$C_{24}$ substituted heteroatom-containing alkenyl, $C_2$-$C_{24}$ substituted heteroatom-containing alkenyl, $C_5$-$C_{24}$ aryl, $C_5$-$C_{24}$ substituted aryl, $C_5$-$C_{24}$ substituted heteroatom-containing aryl, $C_5$-$C_{24}$ substituted heteroatom-containing aryl, $C_1$-$C_{24}$ alkoxy, $C_5$-$C_{24}$ aryloxy, carbonyl, thiocarbonyl, or carboxy. Most preferably, $R_1$, $R_2$ and $R_3$ of formula (I) can be independently selected from hydrogen, $C_1$-$C_{12}$ alkyl, $C_1$-$C_{12}$ substituted alkyl, $C_1$-$C_{12}$ substituted heteroatom-containing alkyl, $C_1$-$C_{12}$ substituted heteroatom-containing alkyl, $C_2$-$C_{12}$ alkenyl, $C_2$-$C_{12}$ substituted alkenyl, $C_2$-$C_{12}$ substituted heteroatom-containing alkenyl, $C_2$-$C_{12}$ substituted heteroatom-containing alkenyl, $C_5$-$C_{14}$ aryl, $C_5$-$C_{14}$ substituted aryl, $C_5$-$C_{14}$ substituted heteroatom-containing aryl, $C_5$-$C_{14}$ substituted heteroatom-containing aryl, $C_2$-$C_{14}$ alkoxy, $C_5$-$C_{14}$ aryloxy, carbonyl, thiocarbonyl, orcarboxy.

Example 2 demonstrates that the fingerprint probe can be an organic molecule of general formula II.

In preferred embodiments, the fingerprint probe is an organic molecule of general formula II, wherein $R_1$ comprises a chemical structure chosen from the group consisting of cyclopropane, cyclobutane, cyclobutene, cyclopentane, cyclopentene, cyclohexane, cyclohexene, cycloheptane, cycloheptene, cyclooctane, cyclooctene, cyclononane, cyclononene, cyclodecane, cyclodecene, cycloundecane, cycloundecene, cyclododecane, cyclododecene, cyclotridecane, cyclotridecene, cyclotetradecane, cyclotetradecene decalin, adamantane, norbornane, bicyclo[2.2.2]octane, bicyclo[3.2.1]octane, bicyclo[3.1.1]heptanes, spiro[5.5]undecane, spiro[4.5]decane, octahydro-1H-indene, decahydroazulene, decahydro-1H-benzo[7]annulene, octahydro-1H-3a,7-methanoazulene, decahydro-1H-cyclopenta[a]pentalene, tetradecahydrophenanthrene, dodecahydro-1H-cyclopenta[a]naphthalene, dodecahydro-1H-fluorene, tetradecahydroanthracene, cembrane, tetradecahydro-6,10-methanobenzo[10]annulene, hexadecahydro-1H-cyclopenta[a]phenanthrene, gonane, docosahydropicene, icosahydro-1H-cyclopenta[a]chrysene, benzene, napthene, anthracene, pyrrole, furan, thiophene, azolidine, oxolane, thiolane, imidazolidine, pyrazolidine, imidazole, imidazoline, pyrazole, pyrazoline, oxazolidine, isoxazolidine, oxazole, oxazoline, isoxazole, isoxazoline, thiazolidine, isothiazolidine, thiazole, thiazoline, isothiazole, isothiazoline, dioxolane, oxathiolane, dithiolane, dithiazole, furazan, oxadiazole, thiadiazole, tetrazole, piperidine, pyridine, tetrahydropyran, pyran, thiane, thiopyran, piperazine, diazines, morpholine, oxazine, thiazine, dithiane, dioxane, dioxin, triazine, trioxane, tetrazine, azepane, azepine, oxepane, oxepine, thiepane, thiepine, diazepine, thiazepine, azetidine, oxetane, thietane, pyrrolidine, tetrahydrofuran, tetrahydrothiophene, pyrrole, furan, thiophene, piperidine, tetrahydropyran, thiane, pyridine, azepane, oxepane, thiepane, azepine, oxepine, thiepine, indole, isoindole, quinoline, isoquinoline, benzofurane, benzothiophene, and benzazepine. Each of the chemical structures mentioned above can be substituted at at least one position. "Substituted" means that in the alkyl, alkenyl, alkynyl, aryl, or other moiety occurring in this compound, at least one hydrogen atom is replaced with at least one non-hydrogen atom.

In other embodiments, the reporter functional group is a N-methyl (—$NHCH_3$), N-dimethyl (—$N(CH_3)_2$), or S-methyl (—$SCH_3$) group. Similarly to the methoxy reporter functional group, the activity of a monooxygenase on a fingerprint probe comprising one or more of these reporter functional groups can be determined using a colorimetric reagent specific for formaldehyde.

In other embodiments, the reporter functional group is a para-nitrophenoxy group, a hydroxycoumarin-containing group, or a resorufin-containing group. Monooxygenase-catalyzed hydroxylation of a carbon atom adjacent to this group releases para-nitrophenol, hydroxycoumarin, or resorufin, respectively, which can be detected spectrophotometrically.

In various embodiments, the number of fingerprint probes in the fingerprint probe set can be varied. In various embodiments, the fingerprint probe set consists of 2 to 5, 2 to 10, 2 to 15, 2 to 20, 2 to 25, etc. up to 2 to 100 probes. In other embodiments, the fingerprint probe set consists of 2 to greater than 100 probes, e.g., 2 to 150, 2 to 200, etc. Preferably, the fingerprint probe set consists of 2 to 15 probes.

Once the activity of a monooxygenase on each probe of the fingerprint probe set is measured, the series of measured probe activities can be compiled to yield a fingerprint of this monooxygenase. This fingerprint may be represented by a series of numbers or, graphically, in the form of a histogram. Each number (or bar of the corresponding histogram) of the fingerprint is referred to herein as a "component" of the fingerprint. Accordingly, a fingerprint component corresponds to the measured monooxygenase activity on a given fingerprint probe. This embodiment is illustrated in Example 1 and 2.

In some embodiments, each fingerprint component is normalized to a reference value. In some embodiments, this reference value is the measured activity of a reference monooxygenase on the corresponding probe. Any monooxygenase can be used as a reference monooxygenase. Most preferably, the reference monooxygenase is chosen so that it exhibits higher than null activity on each one of the fingerprint probes used for fingerprinting, so that the value of the fingerprint components of the reference monooxygenase are higher than zero. By compiling normalized fingerprint components, a normalized fingerprint is obtained. This normalization procedure facilitates the comparison and analysis of monooxygenase fingerprints obtained from distinct experiments and at different point in times (e.g., different days). It also helps reduce the noise in the fingerprinting process when a high-throughput fingerprinting procedure is used. This embodiment is illustrated in Example 2.

In other embodiments, the reference value used for fingerprint normalization is the concentration of the monooxygenase in the fingerprinting assay. The enzyme concentration in the reaction vessel can be measured using techniques well known in the art. For example, the concentration of a P450 monooxygenase can be measured spectrophotometrically using the CO-binding assay. Concentration-normalized fingerprints can be further normalized using the fingerprint of a reference monooxygenases, yielding double normalized fingerprints. Normalization against monooxygenase concentration and double normalization as described above can further facilitate the comparison and analysis of the monooxygenase fingerprints obtained from distinct experiments and under different expression conditions.

5.3 Methods of Monooxygenase Fingerprint Analysis to Predict Substrate Reactivity Toward a Probe-related Target Compound A method is provided for identifying, within a library of fingerprinted monooxygenases, monooxygenases that can accept a target molecule as a substrate for oxygenation, wherein the target molecule is structurally related to at least one of the fingerprint probes.

In one embodiment, the method comprises the steps of (i) providing a set of fingerprint probes; (ii) providing a library of monooxygenases; (iii) contacting each monooxygenase of the library with each fingerprint probe of the set and measuring the monooxygenase activity on each probe, so that a fingerprint is acquired for each member of the monooxygenase library; (iv) measuring the degree of molecular similarity between a target compound and each of the fingerprint probes and (v) ranking the members of the monooxygenase library according to the value of the fingerprint component corresponding to the probe with highest degree of molecular similarity to the target compound; and (iv) isolating the monooxygenase from the library of fingerprinted monooxygenase according to the ranking order. A representative demonstration of this embodiment is set forth in Example 3.

Once the monooxygenases that are predicted to accept a target compound as a substrate for oxidation are identified and isolated according to the method above, the predictions can be validated experimentally according to procedures well known in the art, such as, for example, by contacting the isolated monooxygenase with the target molecule under suitable reaction conditions and quantifying the oxygenated products formed in the reaction under a certain amount of time by HPLC, GC, or other analytical techniques. A person of ordinary skill in the art will be able to select appropriate reaction conditions to carry out these tests according to the nature of the monooxygenase enzyme (e.g., P450 enzyme), its cofactor (e.g., NADPH or NADH) specificity, and the requirement for auxiliary redox enzymes to drive the monooxygenase-dependent oxygenation reaction (e.g., putidaredoxin and putidaredoxin reductase for P450cam).

Various methods are available in the art for measuring the molecular similarity between two organic molecules. Examples of these methods as those described in reference (Chemoinformatics: concepts, methods, and tools for drug discovery (2004); Humana Press (Totowa, N.J.). These methods and variations thereof can be used to measure the degree of molecular similarity between the target substrate and the fingerprint probes. Typically, the degree of molecular similarity is measured through, and expressed in terms of 'similarity coefficients' or 'similarity indexes'. Typically, these coefficients range from a value of 1, which correspond to two molecule being identical, to a value of 0 (=no molecular similarity).

Methods that can be used to calculate the similarity coefficient between the target compound and the fingerprint probes include, for example, set-based methods, graph-based methods, vector-based methods, and function-based methods (Chemoinformatics: concepts, methods, and tools for drug discovery (2004); Humana Press (Totowa, N.J.); Baski, I. I.; Skvortsova, M. I.; Stankevich, I. V.; Zefirov, N. S. J Chem Inf Comput Sci, 1995, 35, 527; Ginn, C. M. R.; Willett, P.; Bradshaw, J. Perspect Drug Discov, 2000, 20, 1; Kvasnička, V.; Pospíchal, J. J math Chem, 1989, 3, 161; Kvasnička, V.; Pospíchal, J. J Mol Struct (Therchem.), 1991, 227, 17; Randić, M. J Chem Inf Comput Sci, 1992, 32, 57; Skvortsova, M. I.; Baski, I. I.; Stankevich, I. V.; Palyulin, V. A.; Zefirov, N. S. J Chem Inf Comput Sci, 1995, 38, 785; Willett, P.; Barnard, J. M.; Downs, G. M. J Chem Inf Comput Sci, 1998, 38, 983).

Alternatively, methods for comparing three-dimensional features of molecules such as those based on electron density, electrostatic-potential fields, and lipophilic potential fields can also be used. In certain embodiments, methods that can be used to calculate the molecular similarity of the target compound to the fingerprint probes can be, for example, methods utilizing 3D shape descriptors, Carbó similarity index, Hodgkin similarity index, Petke similarity index, and distance-based similarity index (Chemoinformatics: concepts, methods, and tools for drug discovery (2004); Humana Press (Totowa, N.J.); Carbó, R.; Calabuig, B. Wiley-Interscience, New York, 1990, pp. 147; Du, Q. S.; Arteca, G. A.; Mezey, P. G. J Comput Aid Mol Des, 1997, 11, 503; Güner, O. F. International University Line, La Jolla, Calif., 2000; Hodgkin, E. E.; Richards, W. G. Int J Quantum Chem, 1987, 105; Lemmen, C.; Lengauer, T. J Comput Aid Mol Des, 2000, 14, 215; Maggiora, G. M.; Petke, J. D.; Mestres, J. Journal of Mathematical Chemistry, 2002, 31, 251; Mansfield, M. L.; Covell, D. G.; Jernigan, R. L. Journal of Chemical Information and Computer Sciences, 2002, 42, 259; Petitjean, M. J Comput Chem, 1995, 16, 80; Petitjean, M. Journal of Chemical Information and Computer Sciences, 1996, 36, 1038; Petke, J. D. J Comput Chem, 1993, 14, 928).

Preferred methods for calculating the similarity index between the target compound and a fingerprint probe are fragment- and descriptor-based algorithms (e.g., Hellinger distance, Tanimoto index) (Rahman, S. A.; Bashton, M.; Holliday, G. L.; Schrader, R.; Thornton, J. M. J. Cheminform., 2009, 1, 1; Godden, J. W.; Xue, L.; Bajorath, J. J. Chem. Inf. Comput. Sci., 2000, 40, 163) and the Maximal Common Substructure algorithm (Cao, Y.; Jiang, T.; Girke, T. Bioinformatics, 2008, 24, 366; Cuissart, B.; Touffet, F.; Cremilleux, B.; Bureau, R.; Rault, S. J. Chem. Inf. Comput. Sci., 2002, 42, 1043), with the Maximal Common Substructure algorithm being particularly preferred.

5.4 Methods of Fingerprint Analysis to Identify Monooxygenases with Reactivity Properties Similar and Different to a Target Monooxygenase A method is provided for identifying, within a library of fingerprinted monooxygenases, monooxygenases that exhibit different reactivity properties compared to another monooxygenase, referred to herein as "target monooxygenase". Such reactivity properties can be a substrate-reactivity property and/or a site-reactivity property as defined above. A representative demonstration of this embodiment of the method is provided in Example 4.

This method comprises the steps of (i) providing a set of fingerprint probes; (ii) providing a library of monooxygenases and a target monooxygenase; (iii) contacting each monooxygenase of the library and the target monooxygenase with each fingerprint probe of the set; (iv) measuring the monooxygenase activity on each probe, thereby acquiring a fingerprint for the target monooxygenase and for each monooxygenase of the library; (v) comparing the acquired fingerprint of each monooxygenase of the library with the fingerprint of the target monooxygenase; and (vi) isolating at least one of the monooxygenases of the library whose fingerprint exhibits a significant (e.g., statistically significant) deviation in at least one components of the acquired fingerprint as compared to the fingerprint of the target monooxygenase.

In another embodiment, the method can comprise the steps (i)-(iv) as indicated above, and further comprise the steps of (v) normalizing each acquired fingerprint of the monooxygenase library to the fingerprint of the target monooxygenase (that is, normalizing the activity of each monooxygenase on each fingerprint probe to the activity of the target monooxygenase on the same probe); and (vi) isolating at least one of the monooxygenases of the library whose normalized fingerprint exhibits a significant deviation from the unit in at least one of the components of the acquired fingerprint.

A method is also provided for identifying, within a library of fingerprinted monooxygenases, monooxygenases that exhibit similar or identical reactivity properties compared to a target monooxygenase. Such reactivity properties can be a substrate-reactivity property and/or a site-reactivity property as defined above. In one embodiment, this method comprises the steps of (i) providing a set of fingerprint probes; (ii) providing a library of monooxygenases and a target monooxygenase; (iii) contacting each monooxygenase of the library with each fingerprint probe of the set; (iv) measuring the monooxygenase activity on each probe of the set, so that a fingerprint is acquired for the target monooxygenase and for each monooxygenase of the library; (v) comparing the acquired fingerprints of the monooxygenases of the library with the fingerprint of the target monooxygenase; and (vi) isolating at least one of the monooxygenases of the library whose fingerprint does not deviate significantly, in any of its components, from the fingerprint of the target monooxygenase.

In another embodiment, the method can comprise the steps (i)-(iv) as indicated above, and further comprise the steps of (v) normalizing each acquired fingerprint of the monooxygenase library to the fingerprint of the target monooxygenase (that is, normalizing the activity of each monooxygenase on each fingerprint probe to the activity of the target monooxygenase on the same probe); and (vi) isolating at least one of the monooxygenases whose normalized fingerprint does not exhibit a significant deviation from the unit in any of its components.

The procedure of fingerprint versus fingerprint comparative analysis recited in the methods above can be carried out using non-normalized fingerprints (raw fingerprint data), fingerprints normalized to that of a reference monooxygenase, concentration-normalized fingerprints, or double normalized fingerprints (i.e., fingerprints normalized to that of a reference monooxygenase and to the enzyme concentration).

A significant difference in one component of a non-normalized or normalized fingerprint indicates a difference that is statistically significant in the context of the assay applied to acquire the fingerprints. As an example, a statistically significant difference can be a variation that exceeds by one, two or three times the coefficient of variation of the assay applied to acquire the fingerprints. The coefficient of variation (CV) of an assay is conventionally defined here as the ratio of the standard deviation to the mean for a set of replicate measurements made with such assay.

5.5 Methods of Monooxygenase Fingerprint Analysis to Identify Monooxygenases that Exhibit a Particular Reactivity Property A method is also provided for identifying, within a library of fingerprinted monooxygenases, monooxygenases that exhibit a specific reactivity property of interest. As described above, a reactivity property can be either a substrate-reactivity property (i.e., the ability of a monooxygenase to accept a given molecule as substrate for oxygenation) or a site-reactivity property (i.e., the ability of a monooxygenase to catalyze the oxygenation of a particular chemical bond or atom in a given molecule). Representative demonstrations of embodiments of this method are provided in Examples 5 and 6.

In one embodiment, the method comprises the steps of (i) providing a set of fingerprint probes; (ii) providing a library of monooxygenases; (iii) contacting each monooxygenase of the library with each fingerprint probe of the set; (iv) measuring the monooxygenase activity on each probe, so that a fingerprint is acquired for each monooxygenase of the library; (v) isolating a subset of fingerprinted monooxygenases from the monooxygenase of the library (the subset of monooxygenases also referred to herein as a "training set" or "monooxygenase training set"; (vi) collecting data characterizing the reactivity property for each monooxygenase of the subset (training set); (vii) correlating the subset (training set) fingerprints with the reactivity property data to generate a fingerprint-reactivity property model that is predictive of the reactivity property as a function of the fingerprint; (viii) ranking the remaining members of the monooxygenase library using the fingerprint-reactivity property model; and (ix) isolating the top-ranking monooxygenases from the monooxygenase library.

Data characterizing the reactivity property, wherein this reactivity property is either a substrate-reactivity property or a site-reactivity property can be obtained using assays, techniques, or screens known in the art that are appropriately designed to measure and quantify this particular reactivity property.

In some embodiments, the reactivity property is a substrate-reactivity property. The property may be characterized and quantified, for example, by contacting the monooxygenase with the target compound under suitable reaction conditions and characterizing the ability of the monooxygenase to accept the target compound as substrate for oxygenation using substrate turnover number, total turnover number, substrate consumption rate, product formation rate, cofactor (e.g., NAD(P)H) consumption rate, cosubstrate (e.g., $O_2$ or $H_2O_2$) consumption rate, and the like. In some embodiments, the substrate-reactivity property is characterized through substrate turnover numbers.

In some embodiments, the reactivity property is a site-reactivity property. The property may be characterized and quantified, for example, by contacting the monooxygenase with the target compound under suitable reaction conditions, and measuring the relative or absolute amount of the oxygenation product resulting from the oxygenation of that particular chemical bond or atom in the target compound. Techniques suitable for these measurements include chromatographic techniques such as HPLC, GC, TLC, and the like. The site-reactivity property may be then expressed in the form of a fraction, percentage, number of turnovers, and the like, also according to the technique applied to quantify it.

In one embodiment, the site-reactivity property may be the selectivity of the monooxygenase for oxygenation of a specific C—H bond in the target compound (e.g., C—H bond of C4 of compound Z), or a specific carbon-carbon double bond in the target compound (e.g., C4-C5 double bond in compound Z), or a specific atom in the target compound (e.g., N10 in compound Z). Such selectivity is commonly described as chemoselectivity in the context of chemical groups of different type (e.g., a C—H bond versus a nitrogen atom) or regioselectivity in the context of chemical groups of the same type (e.g., C—H bonds).

In another embodiment, the site-reactivity property may be the selectivity of the monooxygenase toward oxygenation of a specific C—H bond or atom, wherein such oxygenation leads to the creation of a chiral center (e.g., S-selectivity for oxygenation of C4 in compound Z). Such selectivity is commonly described as stereoselectivity.

The number of monooxygenases in the training set can be varied. Preferably, the training set comprises at least two monooxygenases, wherein at least one monooxygenase exhibits a non-null value for the reactivity property of interest. The monooxygenases in the training set may be randomly chosen from the library of fingerprinted monooxygenases or selected from this library based on prior knowledge of their characteristics.

In another embodiment of the method, after the reactivity property data for the training set monooxygenases has been generated or acquired, these data can be used to generate a fingerprint-reactivity property model that predicts the reactivity property as a function of a monooxygenase fingerprint. Such model is a linear expression, non-linear expression, algorithm or other tool that predicts the relative reactivity property in a monooxygenase when provided with fingerprint information for that monooxygenase. In other words, information corresponding to the monooxygenase fingerprint is the input and a prediction of the reactivity property is the output.

In one embodiment, to generate the fingerprint-reactivity property model, the fingerprint data can be in the form of raw data or normalized to a reference value as described above (e.g., normalized to the fingerprint of a reference monooxygenase, normalized to the monooxygenase concentration in the fingerprinting assay, double normalized to both the enzyme concentration in the fingerprinting assay and to the fingerprint of a reference monooxygenase). Preferably, the fingerprint data are normalized to the fingerprint of a reference monooxygenase.

Various tools are available that can be used to generate such fingerprint-reactivity property models. The form of the fingerprint-reactivity property model can vary widely, as long as it provides a vehicle for approximating the relative value of the reactivity property for a monooxygenase based on fingerprint information. Generally, such model will treat the reactivity property as a dependent variable and the components of the monooxygenase fingerprint as independent variables.

Examples of the mathematical/logical form of models include linear and non-linear mathematical expression of various orders, classification and regression trees or graphs, recursive partitioning, support vector machines, neural networks, and the like. In a preferred embodiment, the model form is a linear additive model in which the products of coefficients and fingerprint component values are summed. In another preferred embodiment, the model form is a non-linear product of fingerprint component-derived terms.

Various techniques are available for generating fingerprint-reactivity property models. A class of techniques that can be used to generate these models are regression techniques that identify covariation of independent and dependent variables in a training set. Various regression techniques are known in the art. Examples include multiple linear regression (MLR), principal component regression (PCR), partial least squares regression (PLS), and multiple non-linear regression (MNL).

MLR models the linear relationship between a dependent variable (reactivity property) and multiple independent variables (fingerprint components) for members of a training set. The dependent variable is also called "criterion" or "predicand", while the independent variables are also called "predictors". In general, a linear regression model of the reactivity property versus fingerprint has the following form:

$$Y = b_o + b_1 * X_1 + b_2 * X_2 + \ldots + b_p * X_p + E$$

where, Y is the predicted response for the reactivity property of interst, $b_o$ is the regression constant, E is an error term, b, are the regression coefficients (for variable 1 through p), and $x_i$ (with i=1 through p) correspond to the values of the fingerprint components for a monooxygenase fingerprint consisting of p components (i.e., acquired using a number p of fingerprint probes).

In this example, by solving the equation for the members of a monooxygenase training set, a MLR model and values for the regression coefficients corresponding to the fingerprint components are obtained. The relative magnitude of the regression coefficients correlates to the relative magnitude of contribution of that particular fingerprint component to the reactivity property of interest. In a subsequent step, the MLR model and associated regression coefficients can be used to rank a series of fingerprinted monooxygenases outside of the training set to determine which of them are more likely to possess such reactivity property or to exhibit such reactivity property in larger extent.

Similar to MLR, PCR and PLS can be used to generate models from equations relating reactivity property data to the fingerprint components. These techniques differ from MLR in that a coordinate transformation is first performed to reduce the number of independent variables. The regression is subsequently carried out on the transformed variables. In general, both PCR and PLS produce factor scores as linear combinations of the original predictor variables (fingerprint component data), so that there is no correlation between the factor score variables used in the predictive regression model. For example, suppose the training data set comprises a large number of predictor variables X, some of which are highly correlated. A regression using factor extraction computes the factor score matrix $T=XW$ for an appropriate weight matrix W, and then considers the linear regression model $Y=TQ+E$, where Q is a matrix of regression coefficients for T, and E is an error (noise) term. Once Q values are computed, the above regression model is equivalent to $Y=XB+E$, where $B=WQ$, which can be used as a predictive regression model. In PCR and PLS, the direct result of the regression is an expression for the reactivity property term that is a function of the weighted predictor variables (i.e., fingerprint components). PCR and PLS differ in the methods used in extracting factor scores. Shortly, PCR produces the weight matrix W reflecting the covariance structure between the predictor variables, while PLS produces the weight matrix W reflecting the covariance structure between the predictor and response variables.

The ability of the regression technique to fit the training set data is often referred to as the "model fit". In regression techniques such as MLR, PCR, and PLS, the model fit is typically measured using the sum squared difference between the measured and the predicted values. R-square, also known as the coefficient of determination is a commonly used term to evaluate model fit. R-square is 1 minus the ratio of residual variability. When the variability of the residual values around the regression line relative to the overall variability is small, the predictions from the regression equation are good. For example, if there is no relationship between the X and Y variables, then the ratio of the residual variability of the Y variable to the original variance is equal to 1.0. Then R-square would be 0. If X and Y are perfectly related then there is no residual variance and the ratio of variance would be 0.0, making R-square=1. In most cases, the ratio and R-square will fall between 0.0 and 1.0. The R-square value can thus serve as an indicator of how well the model fits the data, with an R-square close to 1.0 indicating that almost all of the variability with the variables specified in the model have been accounted for. The degree to which two or more predictor variables (i.e., fingerprint components) are related to the dependent variable Y (reactivity feature) is expressed using the correlation coefficient R, which is the square root of R-square. In multiple regression analyses, R can assume values between 0 and 1. To interpret the direction of the relationship between variables, the signs (plus or minus) of the regression coefficients b can be evaluated. If b coefficient is positive, then the relationship of this variable with the dependent variable is positive (e.g., the greater the value of the corresponding fingerprint component, the higher the value of the reactivity feature); if the b coefficient is negative then the relationship is negative positive (e.g., the greater the value of the corresponding fingerprint component, the lower the value of the reactivity feature). If the b coefficient is equal to 0 then there is no relationship between the variables.

A purely linear, additive model describing the fingerprint-reactivity property relationship as described above can be improved by including one or more non-linear terms in the model equation. Generally, the approach to generating a multiple non-linear regression model is the same as described above for generating a linear model. In other words, a training set is used to fit the data to the model.

Other statistical tools that can be used to generate fingerprint-reactivity property models are support vector machines (SVM). In one embodiment, prior to analysis, the monooxygenases of the training set are classified into two or more groups based on their value for the reactivity feature of interest. For example, the training set data can be divided into a "positive" group and into a "negative" group using a threshold value for the reactivity property (e.g., 1,000 total turnovers on compound Z or 10% site-reactivity toward C4 carbon-hydrogen bond in compound Z). SVM operate by weighting the different members of the training set differently depending on how close they are to a hyperplane interface separating members of the "positive" group and those of the "negative" group. From this classification, SVM will generate a vector, V, which can provide coefficients for each of the independent variables of the positive and negative group members in the training set. These coefficients can be used to rank fingerprints (and thus corresponding monooxygenases) outside the training set based on their predicted reactivity property values. The SVM technique attempts to identify a hyperplane where the distance between the closest training set member on opposite sides of that plane is maximal. In other variations, support vector regression analysis can be used to generate the fingerprint-reactivity property models.

The choice of the regression technique and statistical tool for generating the fingerprint-reactivity property model may be made depending on the specific application (e.g., based on the size of the training set and/or the number of fingerprint components for the training set monooxygenases). For example, if the number of predictor variables (i.e., fingerprint components) is very large or if some of these predictor variables are highly correlated, PCR may be preferred. When the members of the training set are fewer than the number of predictor variables, PLS may be preferred as it is the least restrictive of the various multivariate extensions of the multiple linear regression models. When a non-linear relationship exists between the independent and dependent variables, multiple non-linear regression models may be preferred.

In other cases, different regression techniques and/or statistical tools are applied to generate different fingerprint-reactivity property models. The predictive power (and thus performance) of these models is then assessed and compared through experimental validation of predictions made using the different models. The best performing model is then used as the preferred model to generate reactivity property predictions in subsequent experiments.

As described above, the coefficient of determination (R-square) can also be used to assess the model fit to the training set data, which in turn may be used to guide the choice of suitable (or most suitable) regression technique(s) and/or statistical tool(s) for generating the fingerprint-reactivity property models and then formulating the reactivity property predictions.

In some embodiments, the fingerprint-reactivity feature model is obtained using a multiple linear regression technique, a principal component regression technique, a partial least squares regression technique, a multiple non-linear regression technique, a support vector machines technique, or a support vector regression technique.

Once the fingerprint-reactivity feature model is obtained, the remaining members of the library of fingerprinted monooxygenases (i.e., those not included in the training set) can be ranked based on such model. Based on this ranking order, the top-ranking monooxygenases, which are predicted to have highest probability to exhibit the reactivity property of interest, or highest probability to exhibit such reactivity property in highest extent, can be isolated for further analysis.

Further, it is possible to combine all the above embodiments. For example, it is possible to combine the above embodiments so that the members of a library of monooxygenases that are catalytically active on a target molecule are first identified through fingerprint analysis via single fingerprint component predictions or via trained predictions, and then, among these, the ones that exhibit different reactivity properties isolated via fingerprint comparative analysis. This can be useful, for example, to identify monooxygenase catalysis for functionalizing different site in a target molecule as illustrated in Example 4.

5.6 Methods of Constructing Engineered Libraries of Functionally Diverse Monooxygenases Methods are also provided for defining the functional diversity-generating potential of a mutagenesis event and for defining suitable combinations of mutagenesis events for generating libraries of functionally diverse monooxygenases. Representative demonstrations of embodiments of this method are provided in Example 7.

The term "mutagenesis event" as used herein with reference to a monooxygenase refers to any process or series of processes that lead to a modification of the amino acid sequence of such monooxygenase. Such modification can be a mutation, deletion, and/or insertion of one or more amino acids within the monooxygenase amino acid sequence. Such modification can also be a chemical or enzymatic modification of one or more amino acids within the monooxygenase primary sequence. Examples of mutagenesis events include, but are not limited to, random mutagenesis, site-directed mutagenesis. site-saturation mutagenesis, recombination (e.g., homologous or non-homologous recombination), post-translational modification, unnatural amino acid mutagenesis (e.g., incorporation of unnatural amino acids into the monooxygenase), and the like. The term "mutagenesis scheme" as used herein, in particular, with reference to a monooxygenase, refers to a series and/or combination of two or more mutagenesis events.

The term "parent monooxygenase" or simply "parent" as used herein refers to the monooxygenase which has been subjected to a mutagenesis event. The term "daughter monooxygenases" as used herein refers to the monooxygenase variants derived from a parent monooxygenase after this parent enzyme has been subjected to a mutagenesis event. Typically, a library of "daughter monooxygenases" is obtained after a mutagenesis event. Typically, the members of a library of "daughter monooxygenases" are arrayed so the screening of each of these library members becomes possible.

In one embodiment, a method is provided for measuring the "functional diversity-generating potential" of a mutagenesis event, wherein the term "functional diversity-generating potential" refers to the potential ability of the mutagenesis event to generate monooxygenases with diversified function, and specifically, diversified reactivity properties. This method comprises the steps of (i) subjecting a parent monooxygenase to a mutagenesis event, thereby generating a library of daughter monooxygenases; (ii) providing a set of fingerprint probes; (iii) contacting each monooxygenase of the library with each fingerprint probe of the set; (iv) measuring the monooxygenase activity on each probe, so that a fingerprint is acquired for each member of the monooxygenase library; (v) assessing the functional diversity content of the library and thus the functional diversity-generating potential of the mutagenesis event based on the number of monooxygenases with a unique fingerprint occurring in the library.

In another embodiment, a method is provided for defining suitable combinations of mutagenesis events for generating libraries of monooxygenases with diversified function, and specifically, diversified reactivity properties. The method comprises the steps of (i) providing a set of mutagenesis events, wherein this set comprises two or more mutagenesis events; (ii) subjecting a parent monooxygenase to each of the mutagenesis event in the set, thereby generating a library of daughter monooxygenases from each mutagenesis event; (iii) providing a set of fingerprint probes; (iv) contacting each monooxygenase of each library with each fingerprint probe of the set; (v) measuring the monooxygenase activity on each probe, so that a fingerprint is acquired for each member of each monooxygenase library; (vi) ranking the mutagenesis events according to their functional diversity-generating potential, wherein such potential correspond to the number of monooxygenases with a unique fingerprint occurring in the corresponding library; (vii) constructing a second-generation library of monooxygenases by combining mutagenesis events with the highest scores of functional diversity-generating potential.

Various techniques are known in the art that can be used to mutate a polypeptide sequence and that can thus be used to generate a mutagenesis event within the scope of the methods disclosed here. Mutagenesis events can be generated by site-directed mutagenesis (Botstein, D. and D. Shortie (1985). Science 229(4719): 1193-120; Smith, M. (1985). Annu Rev Genet 19: 423-462; Carter, P. (1986). Biochem J 237(1): 1-7; Dale, S. J. and I. R. Felix (1996). Methods Mol Biol 57: 55-64; Ling, M. M. and B. H. Robinson (1997). Anal Biochem 254(2): 157-178), mutagenesis using uracil containing templates (Kunkel, T. A., J. D. Roberts, et al. (1987). Methods Enzymol 154: 367-382; Bass, S., V. Sorrells, et al. (1988). Science 242(4876): 240-245), oligonucleotide-directed mutagenesis (Zoller, M. J. (1992). Curr Opin Biotechnol 3(4): 348-354; Zoller, M. J. and M. Smith (1983) Methods Enzymol 100: 468-500; Zoller, M. J. and M. Smith (1987). Methods Enzymol 154: 329-350), phosphorothioate-modified DNA mutagenesis (Taylor, J. W., W. Schmidt, et al. (1985). Nucleic Acids Res 13(24): 8749-8764.; Nakamaye, K. L. and F. Eckstein (1986). Nucleic Acids Res 14(24): 9679-9698.; Sayers, J. R., W. Schmidt, et al. (1988). Nucleic Acids Res 16(3): 791-802), mutagenesis using gapped duplex DNA (Kramer, W., V. Drutsa, et al. (1984). Nucleic Acids Res 12(24): 9441-9456; Kramer, W. and H. J. Fritz (1987). Methods Enzymol 154: 350-367), point mismatch, mutagenesis using repair-deficient host strains, deletion mutagenesis (Eghtedarzadeh, M. K. and S. Henikoff (1986). Nucleic Acids Res 14(12): 5115), restriction-selection and restriction-purification (Braxton, S, and J. A. Wells (1991). J Biol Chem 266(18): 11797-11800), mutagenesis by total gene synthesis (Nambiar, K. P., J. Stackhouse, et al. (1984). Science 223 (4642): 1299-1301; Grundstrom, T., W. M. Zenke, et al. (1985). Nucleic Acids Res 13(9): 3305-3316; Wells, J. A., M. Vasser, et al. (1985). Gene 34(2-3): 315-323), double-strand break repair (Mandecki, W. (1986). Proc Natl Acad Sci USA 83(19): 7177-7181), and the like. Additional details on many of the above methods can be found in Methods in Enzymology Volume 154.

Additional techniques suitable for generating a mutagenesis event for the use of the methods can be found in the following U.S. patents, PCT publications, and EPO publications: U.S. Pat. No. 5,605,793 to Stemmer (Feb. 25, 1997), "Methods for In vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No.

5,834,252 to Stemmer, et al. (Nov. 10, 1998) "End-Complementary Polymerase Reaction;" U.S. Pat. No. 5,837,458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;" WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/13487 by Stemmer et al., "Methods for Optimization of Gene Therapy by Recursive Sequence Shuffling and Selection;" WO 00/00632, "Methods for Generating Highly Diverse Libraries;" WO 00/09679, "Methods for Obtaining in vitro Recombined Polynucleotide Sequence Banks and Resulting Sequences;" WO 98/42832 by Arnold et al., "Recombination of Polynucleotide Sequences Using Random or Defined Primers;" WO 99/29902 by Arnold et al., "Method for Creating Polynucleotide and Polypeptide Sequences;" WO 98/41653 by Vind, "An in vitro Method for Construction of a DNA Library;" WO 98/41622 by Borchert et al., "Method for Constructing a Library Using DNA Shuffling;" WO 98/42727 by Pati and Zarling, "Sequence Alterations using Homologous Recombination;" WO 00/18906 by Patten et al., "Shuffling of Codon-Altered Genes;" WO 00/04190 by del Cardayre et al. "Evolution of Whole Cells and Organisms by Recursive Recombination;" WO 00/42561 by Crameri et al., "Oligonucleotide Mediated Nucleic Acid Recombination;" WO 00/42559 by Selifonov and Stemmer "Methods of Populating Data Structures for Use in Evolutionary Simulations;" WO 00/42560 by Selifonov et al., "Methods for Making Character Strings, Polynucleotides & Polypeptides Having Desired Characteristics;" WO 01/23401 by Welch et al., "Use of Codon-Varied Oligonucleotide Synthesis for Synthetic Shuffling;" and WO 01/64864 "Single-Stranded Nucleic Acid Template-Mediated Recombination and Nucleic Acid Fragment Isolation" by Affholter.

In particular, in some embodiments, the mutagenesis events correspond to site-directed mutagenesis on predetermined residues of the monooxygenase. These predetermined sites can be identified using the crystal structure of said monooxygenase if available or a crystal structure of a homologous protein that shares at least 20% sequence identity with said monooxygenase and an alignment of the polynucleotide or amino acid sequences of the monooxygenase and its homologous protein. Mutagenesis of the predetermined sites can be performed changing one, two or three of the nucleotides in the codon that encodes for each of the predetermined amino acids. Mutagenesis of the predetermined sites can be performed in the described way so that each of the predetermined amino acid is mutated to any of the other 19 natural amino acids or to an unnatural amino acid. Substitution of the predetermined sites with unnatural amino acids can be performed using established in vivo (Wang, L., J. Xie, et al. (2006). Annu. Rev. Biophys. Biomol. Struct. 35: 225-249), in vitro (Shimizu, Y., Y. Kuruma, et al. (2006). FEBS J. 273(18): 4133-4140), semisynthetic (Schwarzer, D. and P. A. Cole (2005). Curr. Opin. Chem. Biol. 9(6): 561-569) or synthetic methods (Camarero, J. A. and A. R. Mitchell (2005). Protein Pept. Lett. 12(8): 723-728) for incorporation of unnatural amino acids into polypeptides.

In still further embodiments, the mutagenesis event can correspond to polypeptide mutagenesis via directed evolution and/or rational design, using one or a combination of techniques well known in the art, such as, for example, random mutagenesis, site-saturation mutagenesis, site-directed mutagenesis, DNA shuffling, DNA recombination, homologous and non-homologous recombination, and the like and targeting one or more of the amino acid residues, one at a time or simultaneously, comprised in the monooxygenase amino acid sequence.

Methods for identifying monooxygenases with a unique fingerprint within a library of fingerprinted monooxygenases have been described above and exemplified in Example 2. These methods can be used to assess the functional diversity-generating potential of a given mutagenesis event. In some embodiments, the functional-diversity potential of a mutagenesis event corresponds to the number of monooxygenases with a unique fingerprint occurring in the daughter monooxygenase library obtained through said mutagenesis event.

According to the methods of the inventions, starting from a parent monooxygenase, a series of mutagenesis events can be used to produce a series of daughter monooxygenase libraries. After fingerprinting each of these libraries according to the methods described earlier, a functional diversity-generating score can assigned to each mutagenesis event which can correspond to the number of monooxygenases with a unique fingerprint occurring in the library. Based on these scores, the different mutagenesis events can be ranked according to their functional diversity-generating potential, In a subsequent step, the parent monooxygenase can be subjected to two or more mutagenesis events with the highest scores to generate a daughter monooxygenase library enriched in functionally diverse variants. Any monooxygenase can serve as a parent monooxygenase. Furthermore, any mutagenesis techniques can be used to produce a mutagenesis event in the context of a given parent monooxygenase.

5.7 Monooxygenases for Use with the Methods

The methods and systems disclosed herein can be applied to predict reactivity properties (e.g., substrate acceptance, regio- and stereoselectivity properties) of enzymes exhibiting monooxygenase activity such as those conventionally classified under the Enzyme Commission numbers EC 1.13 and EC 1.14 and variants thereof. While different classes of monooxygenases differ by the nature of the catalytic center (e.g., the heme prosthetic group in P450 monooxygenase vs. flavin prosthetic group in flavin-dependent monooxygenase), the forces that dictate substrate recognition (i.e., weak, non-covalent interaction such as hydrogen bonds, van der Waals interaction, etc.) are the same. Accordingly, the methods provided herein can be applied to all enzymes that are capable of catalyzing a monooxygenation reaction.

As defined above, the term "monooxygenase" is used herein to refer to an polypeptide that possesses the ability to catalyze an oxygenation reaction and, specifically, a monooxygenation reaction, wherein this "monooxygenation reaction" is a chemical reaction by which an oxygen atom is inserted into a chemical bond or added to an atom. Monooxygenases suitable for use of the methods of the invention include heme-dependent, flavin-dependent, copper-dependent, non-heme iron-dependent, pterin-dependent, and cofactor-independent monooxygenases.

In some embodiments, the monooxygenases for use according to the methods provided herein are heme-dependent monooxygenases, also referred to as cytochrome P450 monooxygenases, such as those conventionally classified under the Enzyme Commission numbers EC 1.14.13, EC 1.14.14, and EC 1.14.15 and variants thereof. Cytochrome P450 monooxygenases share a common overall fold and topology despite less than 20% sequence identity across the corresponding gene superfamily. In particular, P450 enzymes share a conserved P450 structural core, which binds to a heme (iron protoporphyrin IX) prosthetic group via a conserved cysteine residue. In particular, the conserved cysteine that binds to the heme group is the proximal or "fifth" ligand to the heme iron and the relevant ligand group (a thiolate) is the origin of the characteristic name giving 450-nm Soret absorbance observed for the ferrous-CO complex. These features can be used to identify an enzyme, such as a P450 enzyme, according to the methods disclosed herein.

Cytochrome P450 monooxygenases suitable in the methods and systems herein disclosed include, but are not limited to, cytochrome P450 monooxygenases from different sources (bacterial, fungi, yeast, plant, mammalian, and human), and variants thereof. Exemplary P450 monooxygenases suitable in the methods and systems herein disclosed include, but are not limited to, members of CYP102A subfamily (e.g., CYP102A1, CYP102A2, CYP102A3, CYP102A4, CYP102A5, CYP102A6, CYP102A7, CYP102A8, CYP102A9, CYP102A10, CYP102A11, CYP102A12, CYP102A13), members of CYP101A subfamily (e.g CYP101A1), members of CYP102e subfamily (e.g., CYP102E1), members of CYP1A subfamily (e.g., CYP1A1, CYP1A2), members of CYP2A subfamily (e.g CYP2A3, CYP2A4, CYP2A5, CYP2A6, CYP2A12, CYP2A13), members of CYP1B subfamily (e.g CYP1B1), members of CYP2B subfamily (e.g., CYP2B6), members of CYP2C subfamily (e.g., CYP2C8, CYP2C9, CYP2C10, CYP2C18, CYP2C19) members of CYP2D subfamily (e.g., CYP2D6), members of CYP3A subfamily (e.g., CYP3A4, CYP3A5, CYP3A7, CYP3A43), members of CYP107A subfamily (e.g., CYP107A1), members of CYP153 family (e.g., CYP153A1, CYP153A2, CYP153A6, CYP153A7, CYP153A8, CYP153A11, CYP153D3, CYP153D2), and variants thereof.

Other exemplary P450 monooxygenases suitable in the methods and systems herein disclosed include, but are not limited to, CYP106A2, CYP2F1, CYP2J2, CYP2R1, CYP2S1, CYP2U1, CYP2W1, CYP4A11, CYP4A22, CYP4B1, CYP4F2, CYP4F3, CYP4F8, CYP4F11, CYP4F12, CYP4F22, CYP4V2, CYP4X1, CYP4Z1, CYP5A1, CYP7A1, CYP7B1, CYP8A1, CYP8B1, CYP11A1, CYP11B1, CYP11B2, CYP17A1, CYP19A1, CYP20A1, CYP21A2, CYP24A1, CYP26A1, CYP26B1, CYP26C1, CYP27A1, CYP27C1, CYP39A1, CYP46A1, CYP51A1, and variants thereof.

In particular, in some embodiments, the monooxygenases are P450 monooxygenases with SEQ ID NOs. 1-151 (FIGS. 17-1 to 17-33) and variants thereof.

In some embodiments, the P450 enzyme is comprised in a P450-comprising system, that is, a system comprising a P450 enzyme and one or more agents, typically proteins, which deliver one or more electrons to the heme iron in the P450 enzyme. Natural P450-comprising systems include, but are not limited to: (i) CYP reductase (CPR)/cytochrome b5 (cyb5)/P450 systems, which involve the reduction of cytochrome P450 reductase (variously CPR, POR, or CYPOR) by NADPH or NADH, and the transfer of reducing power as electrons to the CYP; (ii) Ferrodoxin Reductase (FdxR) or Putidaredoxin Reductase (PdxR)/Ferrodoxin (Fdx) or Putidaredoxin (Pdx)/P450 systems, where the reducing electrons from a soluble cofactor, typically NADPH or NADH, are transferred through the reductase to electron carrier, Fdx or Pdx, and transferred from the electron carrier to the P450 component; (iii) P450-CPR fusion systems, where the CYP domain is naturally fused to the electron donating partners (e.g., CYP102A1); (iv) CYB5R/cyb5/P450 systems, where both electrons required by the CYP derive from cytochrome b5; (v) FMN/Fd/P450 systems, where a FMN-domain-containing reductase is fused to the CYP; (vi) P450 only systems, which do not require external reducing power (e.g., CYP5, CYP8, and CYP74A). Artificial P450-comprising systems include, but are not limited to, the systems employing non-protein agents such as electrodes or light in combination or not with redox active compounds, which deliver one or more electrons to the P450 enzyme to drive catalysis.

In some embodiments, the monooxygenases are flavin-dependent monooxygenases such as those conventionally classified under the Enzyme Commission numbers EC 1.13 and EC 1.14 and variants thereof. Flavin-dependent monooxygenases contain a non-covalently bound, and in some cases covalently bound, FAD or FMN flavin. In one embodiment, these features can be used to identify an enzyme as a flavin-dependent monooxygenase.

Exemplary flavin-dependent monooxygenases suitable in the methods and systems herein disclosed include, but are not limited to: (i) members of class A flavin-dependent monooxygenases, which are encoded by a single gene, are FAD-dependent, use NADPH or NADH as cofactor, and comprise one dinucleotide binding domain (Rossman fold) that binds FAD such as, for example, 4-hydroxybenzoate 3-monooxygenase (EC 1.14.13.2), 2-hydroxybiphenyl 3-monooxygenase (EC 1.14.13.44), phenol 2-monooxygenase, and salicylate 1-monooxygenase (EC 1.14.13.1), hydroxybiphenyl 3-monooxygenase; (ii) members of class B flavin-dependent monooxygenases, that are encoded by a single gene, are FAD-dependent, use NADPH as cofactor, and comprise two dinucleotide binding domains (Rossman fold) that bind to FAD and NADPH, respectively, such as, for example, cyclohexanone monooxygenase (EC 1.14.13.22), 4-hydroxyacetophenone monooxygenase (EC 1.14.13.84), cyclopentanone monooxygenase (EC 1.14.13.16), phenylacetone monooxygenase; (iii) members of class C flavin-dependent monooxygenases, that are encoded by multiple genes (a monooxygenase component displaying a TIM-barrel fold and a reductase component), are FMN-dependent, and use NADPH or NADH as cofactor; (iv) members of class D and class E flavin-dependent monooxygenases, which are encoded by two genes (one monooxygenase component and one reductase component), are FAD-dependent, and use NADPH or NADH as cofactor, such as, for example, 4-hydroxyphenylacetate 3-monooxygenase (EC 1.14.13.3), 4-nitrophenol monooxygenase, 2,4,5-trichlorophenol monooxygenase, styrene monooxygenase In some embodiments, the methods and systems can be applied to variants of the monooxygenase enzymes mentioned above. Such variants can be derived from mutating a naturally occurring monooxygenase or a variant thereof using laboratory evolutionary methods and/or rational design methods, using one or a combination of techniques such as random mutagenesis, site-saturation mutagenesis, site-directed mutagenesis, DNA shuffling, DNA recombination, and additional techniques identifiable by a skilled person. In particular, mutating a monooxygenase can be performed by targeting one or more of the amino acid residues comprised in the oxygenase's nucleotidic or amino acidic primary sequence to provide a mutant or variant polynucleotide or polypeptide. Mutating a monooxygenase includes, but is not limited to, mutation in the polypeptide sequence, incorporation of one or more non-natural amino acids in the polypeptide sequence, post-translational modification of one or more amino acid in the polypeptide sequences, including incorporation of non-natural amino acids. Non-limiting examples of a modified amino acid include a glycosylated amino acid, a sulfated amino acid, a prenylated (e.g., farnesylated, geranylgeranylated) amino acid, an acetylated amino acid, an acylated amino acid, a PEGylated amino acid, a biotinylated amino acid, a carboxylated amino acid, a phosphorylated amino acid, and the like.

The following examples are offered by way of illustration and not by way of limitation.

6. EXAMPLES

6.1 Example 1

Fingerprinting of a Monooxygenase Library Using Different Probes Sets

This example illustrates how functional fingerprints for a library of P450 monooxygenases can be acquired according to the methods provided herein. In particular, this example illustrates how a library of P450 monooxygenase variants can be fingerprinted using a set of fingerprint probes of general formula I. In this case, a first set of fingerprint probes (FP probe set 1) was assembled which include the organic molecules of FIG. 2A. A second set of fingerprint probes (FP probe set 2) was also assembled which include the organic molecules of FIG. 3A. In both cases, a collection of P450 monooxygenases including wild-type CYP102A1 (SEQ ID NO:1) and various engineered CYP102A1 variants (SEQ ID NO:3, SEQ ID NO:4, SEQ ID NO:6, SEQ ID NO:8, SEQ ID NO:9, SEQ ID NO:10, SEQ ID NO:11, SEQ ID NO:14, SEQ ID NO:15) in purified form was used as the monooxygenase library. In this example, probe activity was measured by mixing each P450 monooxygenase (0.2 µM) with the fingerprint probe (0.25 mM) in phosphate buffer (pH 8.0), adding NADPH (200 µM) and measuring probe-induced NADPH oxidation based on the decrease of absorbance at 340 nm. Accordingly, probe activities were expressed as NADPH oxidation rates (nmol NADPH/nmol P450) and such probe activities were then compiled to yield a functional fingerprint for each member of the monooxygenase library for FP probe set 1 (FIG. 2B) and for FP probe set 2 (FIG. 3B).

As apparent from the profiles provided in FIGS. 2B and 3B, different set of fingerprint probes yield different fingerprint profiles for the same monooxygenase. Because of the different types of molecular scaffold comprise in FP probe set 1 and 2, the two fingerprints encode different sets of information regarding the active site configuration of the corresponding monooxygenase. Fingerprints obtained using different set of fingerprint probes can be employed and analyzed, according to various embodiments of the methods provided herein, to be used to predict monooxygenase reactivity. Their relative ability to encode and thus convey relevant information for the specific application of interest can be assessed based on the accuracy of the predictions obtained through their analysis. From these comparatives studies, a most suitable set of fingerprint probes can then be selected for the specific application of interest, which can be, for example, predicting substrate-reactivity and/or site-reactivity toward a particular target compound of interest.

Experimental Details for Example 1

Protein Expression and Purification. P450s were expressed from pCWori-based vectors containing the P450 gene under the control of a double tac promoter (BamH I/EcoR I cassette).

Typically, cultures of recombinant DH5α cells in TB medium (ampicillin, 100 mg L$^{-1}$) were grown at 37° C. until OD$_{600}$ reached 1.0 and then induced with 0.25 mM β-D-1-thiogalacto-pyranoside (IPTG) and 0.3 mM δ-aminolevulinic acid (ALA). After induction, cultures were shaken at 200 rpm and 27° C. and harvested after 18 hrs by centrifugation at 4,000 rpm. Cell lysates were prepared by sonication and loaded on Q resin. P450s were then eluted from the column using 20 mM Tris, 340 mM NaCl, pH 8.0. After buffer exchange (50 mM potassium phosphate buffer, pH 8.0), the enzymes were stored at −80° C. P450 concentration was determined from CO binding difference spectra ($\delta_{450-500}$= 91,000 M$^{-1}$ cm$^{-1}$). PTDH was overexpressed from pET15b-based vectors in BL21(DE3) cells and purified using Ni-affinity chromatography according to published procedures.

Measurement of Probe Activity. The five compounds chosen to compose the first set of fingerprint probes were abietic acid (A1), beta-caryophyllene (A2), sclareolide (A3), gibberellic acid (A4), 9-fluorenone (A5). The five compounds chosen to compose the second set of fingerprint probes were phenylbutazone (A6), 2-methyl-cyclopenten-1-one (A7), 1-bromohexane (A8), picrotoxin (A9), and guaiacol (A10). These compounds were purchased from Aldrich, TCI, and CCI. Probe activity was measured based on initial NADPH consumption rates (decrease of OD$_{340}$) upon addition of NADPH (200 µM) to a mixture of the enzyme (100 nM) and probe (250 µM) in phosphate buffer (pH=8). Kinetic determinations were carried out using a Shimadzu UV-2401 PC spectrometer. The procedure was repeated for all the probes and enzymes to yield the corresponding fingerprints provided in FIGS. 2B and 3B.

6.2 Example 2

Design, Synthesis, and Application of Methoxy-containing Probes for Monooxygenase Fingerprinting This example illustrates how probes containing a reporter functional group in the form of a methoxy group can be prepared and utilized to acquire a functional fingerprint for a collection of P450 monooxygenases according to the methods provided herein. In particular, five methoxy-containing fingerprint probes of general formula II were synthesized starting from 4-pentyl-cyclohexanol, (−)-borneol, 2-adamantanol, nootkatone, and progesterone (compounds I-5, FIG. 4A). (−)-Borneol, nootkatone, and progesterone are members of the terpene family of natural products, which further illustrates how naturally occurring compounds can also be utilized to generate methoxy-containing probes for use in the methods provided herein, in addition to synthetic molecules (e.g., 2-adamantanol).

This probe set was designed to contain a series of molecular scaffolds with marked differences in structure, size, and bulkiness. The reporter methoxy groups were installed on these structures to enable rapid profiling of P450 activity on these probes using a Purpald-based colorimetric assay, which detects the product (formaldehyde) of P450-dependent demethylation of this functional group. Importantly, with methoxy-containing probes, the screen readout (i.e., probe activity readout) is a direct measure of the C—H oxidation activity of the monooxygenase. In turn, this can be important toward isolating monooxygenase catalysts which exhibit more coupled catalytic cycles and can therefore support higher turnover numbers on the target molecule of interest. In addition, measurement of probe activity on methoxy-containing probes and the Purpald assay can be carried out using monooxygenases in complex media (e.g., cell lysate).

To test the viability of compounds 1-5 as probes, the fatty acid hydroxylase CYP102A1 (SEQ ID NO 1) from *Bacillus megaterium* and ten engineered variants thereof (SEQ ID NO 3, SEQ ID NO 4, SEQ ID NO 5, SEQ ID NO 6, SEQ ID NO 8, SEQ ID NO 11, SEQ ID NO 12, SEQ ID NO 14, SEQ ID NO 15) were fingerprinted. Prior experiments showed that these P450 variants exhibit varying activity and selectivity in the oxidation of non-native small-molecule substrates. Parallel reactions with 1-5 were carried out using these P450s in purified form and a NADPH cofactor regeneration system containing a phosphate dehydrogenase (PTDH). Notably, each variant was found to be associated to a unique fingerprint FIG. 5A), supporting the ability of these profiles to capture the functional differences among these P450s. In addition, the relative activity of each P450 variant on 1, 2, and 3 varied considerably in spite of the comparable size of these molecules (±20 Da), indicating that these probes can effectively report on the different geometric constraints within the active site of these enzymes.

We investigated the utility of these probes for high-throughput profiling of a large library of engineered monooxygenase variants. To this end, triple and quadruple mutant libraries were constructed by site-saturation mutagenesis of positions V78, S81, V82, A87, L181, and V184 in monooxygenase FL#62 (SEQ ID NO 15), which exhibited high activity on all the probes (FIG. 5A). Targeting these sites was expected to be most effective in altering the active site configuration of FL#62 (SEQ ID NO 15) as the corresponding amino acid residues project their side chains toward the heme pocket and substrate channel of the enzyme based on the available crystal structure of CYP102A1 (SEQ ID NO 1), from which FL#62 (SEQ ID NO 15) was derived. The P450 libraries were expressed in 96-well plates (DH5a cells) and screened against probes 1-5 in parallel to acquire a fingerprint for each functional P450 variant occurring in these libraries. Reactions with the probes (1 mM, 60 min) were carried out using cell lysate in the presence of the phosphite/PTDH cofactor regeneration system, and probe activity was quantified based on absorbance at 550 nm after 60-min incubation with Purpald (30 mM). To facilitate the comparisons among the fingerprints, the probe activities were normalized to that of a reference P450, FL#41 (SEQ ID NO 3), which has minimal yet detectable activity on all five probes (FIG. 5A). Wild-type CYP102A1 (SEQ ID NO 1) was less suitable for this purpose as it shows no activity on three out of the five probes (FIG. 5A). From the screening of 10,000 recombinants, a total of 1,220 catalytically functional P450 variants were identified, the threshold for defining a variant as functional was that it exhibited more than 20% of parental activity (i.e., activity of FL#62 (SEQ ID NO 15)) on at least one of the five probes. Comparative analysis of the normalized P450 fingerprints revealed the occurrence of 261 variants (21%) featuring a unique profile, a representative sample (25) of which is provided in FIG. 5B. Since the variation coefficient of the assay was determined to be 10%, a variation larger than ±20% in at least one of the five fingerprint components served as criterion to define two fingerprints as distinct (i.e., significantly different). This example illustrates how probes of general formula II such as compound 1-5 could be used for fingerprinting a large library of monooxygenases in a high throughput manner. It also illustrates how acquisition and analysis of the fingerprints according to the methods disclosed herein enabled the rapid identification, within a large monooxygenase library, of (a) those monooxygenases that are functional, as judged by the ability to oxidize at least one of the probe), (b) those monooxygenases that exhibit a unique active site configuration, as judged by their unique fingerprint profile, and (c) those monooxygenases that exhibit a similar or identical active site configuration to either the parental enzyme (FL#62 (SEQ ID NO 15)) or another member of the library as judged by their shared fingerprint profile.

Experimental Details for Example 2

Synthesis of 4-pentylcyclohexanol methyl ether (probe 1). Under argon, to a solution of 4-pentylcyclohexanol (2.0 g, 11.75 mmol) in anhydrous THF (60 mL), NaH was added (60%, 0.94 g, 23.5 mmol) at 0° C. and stirred for 30 minutes, followed by the addition of dimethyl sulfate (1.68 mL, 17.62 mmol). The mixture was refluxed for 12 hrs and cooled to 0° C. The reaction was quenched with saturated ammonium chloride solution (20 mL). THF was removed under vacuum and the residue was extracted with $CH_2Cl_2$ (3×25 mL). The collected organic portion was dried with $Na_2SO_4$ and concentrated. The crude product was purified by flash chromatography (hexanes/ethyl acetate: 15/1) to provide probe 1 (2.0 g, quant.) as a colorless liquid. $^1H$ NMR (400 MHz, $CDCl_3$): δ=0.79-0.85 (m, 10 H), 1.28-1.38 (m, 7 H), 1.46 (br, 2 H), 2.02 (br, 2 H), 3.32 (s, 3 H). $^{13}C$ NMR (100 MHz, $CDCl_3$): δ=8.1, 20.9 (2 carbons), 24.1 (2 carbons), 30.2 (2 carbons), 32.6, 34.8, 45.2, 55.5, 74.8; MS (ESI) calcd for $C_{12}H_{25}O$ $[M+H]^+$/z: 185.19. found: 185.31.

Synthesis of (−)-borneol methyl ether (probe 2). Under argon, to the solution of (−)-borneol (1.2 g, 7.79 mmol) in anhydrous THF (40 mL), NaH (60%, 0.62 g, 23.5 mmol) was added at 0° C. and stirred for 30 min, followed by the addition of dimethyl sulfonate (1.11 mL, 11.68 mmol). The mixture was refluxed for 12 hrs and cooled to 0° C. The reaction was quenched with saturated ammonium chloride solution (20 mL). THF was removed under vacuum and the residue was extracted with $CH_2Cl_2$ (3×20 mL). The collected organic portion was dried with $Na_2SO_4$ and concentrated. The crude product was purified by flash chromatography (hexanes/dichloromethane:2/1) to provide probe 2 (1.05 g, 80%) as a colorless liquid. $^1H$ NMR (400 MHz, $CDCl_3$): δ=0.88-0.90 (m, 6 H), 0.92 (s, 3 H), 1.04-1.07 (dd, 1 H, J=13.2 Hz, J=3.3 Hz), 1.23-1.29 (m, 2 H), 1.68 (dd, 1 H, J=4.7 Hz, J=4.7 Hz), 1.74 (m, 1 H), 1.96 (m, 1 H), 2.18 (m, 1 H), 3.36 (s, 3 H), 3.53 (m, 1 H); $^{13}C$ NMR (100 MHz, $CDCl_3$): δ=14.0, 18.8, 19.8, 26.6, 28.3, 35.8, 44.9, 47.9, 49.0, 57.7, 86.7; MS (ESI) calcd for $C_{11}H_{21}O$ $[M+H]^+$/z: 169.16. found: 169.32.

Synthesis of 2-adamantanol methyl ether (probe 3). Under argon, to the solution of 2-adamantanol (1.2 g, 7.79 mmol) in anhydrous THF (40 mL), NaH (60%, 0.62 g, 23.5 mmol) was added at 0° C. and stirred for 30 min, followed by the addition of dimethyl sulfate (1.11 mL, 11.68 mmol). The mixture was refluxed for 12 hrs and cooled to 0° C. The reaction was quenched with saturated ammonium chloride solution (20 mL). THF was removed under vacuum and the residue was extracted with $CH_2Cl_2$ (3×20 mL). The collected organic portion was dried with $Na_2SO_4$ and concentrated. The crude product was purified by flash chromatography (hexanes/dichloromethane:2/1) to provide probe 3 (1.05 g, 80%) as a colorless liquid. $^1H$ NMR (500 MHz, $CDCl_3$): δ=1.49-1.54

(m, 2 H), 1.67-1.72 (m, 2H), 1.75 (br, 2H), 1.80-1.92 (m, 4 H), 2.02-2.09 (m, 4 H), 3.36-3.39 (m, 4 H); $^{13}$C NMR (100 MHz, CDCl$_3$): δ=27.4, 27.5, 31.3 (2 carbons), 31.4 (2 carbons), 36.5 (2 carbons), 37.6, 55.2, 83.3; MS (ESI) calcd for C$_{11}$H$_{19}$O [M+H]$^+$/z: 167.14. found: 167.24.

Synthesis of (1R,7R,9S)-3-methoxy-1,2,3,5,6,7,8,9-octahydro-1,9-dimethyl-7-(1'-methoxy-1'-methylethyl)naphthalene (probe 4). Probe 4 was synthesized according to the synthetic route in FIG. 4B. A solution of nootkatone 25 (500 mg, 2.3 mmol) in 20 mL methanol was prepared and added with 1 mL concentrated hydrochloride acid. The reaction was refluxed for 12 hrs and quenched with saturated NaHCO$_3$ solution. After removal of methanol under vacuum, the residue was extracted with CH$_2$Cl$_2$ (2×15 mL). The organic fraction was dried with anhydrous Na$_2$SO$_4$ and concentrated and purified by flash chromatography (hexanes/ethyl acetate: 8/1) to afford 26 (402 mg, 73%). Sodium borohydride (190 mg, 5.0 mmol) was added to the solution of 26 in methanol (10 mL) at 0° C. and stirred for 2 hrs at 0° C. The reaction was quenched with 2 mL ice-cold water. The methanol was removed under vacuum and the residue was extracted with CH$_2$Cl$_2$ (2×15 mL). The organic fraction was dried with anhydrous Na$_2$SO$_4$ and concentrated to provide compound 27 in quantitative yield. Under argon, to a solution of compound 27 (0.4 g, 1.65 mmol) in anhydrous THF (15 mL), NaH (60%, 0.17 g, 6.61 mmol) was added at 0° C. and stirred for 30 min followed by the addition of dimethyl sulfate (0.47 mL, 4.95 mmol). The mixture was refluxed for 6 hrs and cooled to 0° C. The reaction was quenched with saturated ammonium chloride solution (20 mL). THF was removed under vacuum and the residue was extracted with CH$_2$Cl$_2$ (3×10 mL). The collected organic portion was dried with Na$_2$SO$_4$ and concentrated. The crude product was purified by flash chromatography (hexanes/ethyl acetate: 5/1) to afford probe 4 (0.38 g, 90%) as a light yellow liquid. $^1$H NMR (500 MHz, CDCl$_3$): δ=0.82 (m, 1 H), 0.96 (d, 3 H, J=6.92 Hz), 1.00 (s, 3 H), 1.07 (m, 1 H), 1.11 (s, 3 H), 1.14 (s, H), 1.42 (m, 1 H), 1.53 (m, 1 H), 1.80-1.93 (m, 3 H), 2.17 (m, 1 H), 2.34 (m, 1 H), 3.22 (s, 3 H), 3.23 (s, 3 H), 3.88 (m, 1 H), 5.35 (m, 2 H); $^{13}$C NMR (100 MHz, CDCl$_3$): δ=15.6, 18.2, 22.2, 22.4, 28.8, 32.6, 33.1, 38.2, 39.2, 40.1, 40.6, 48.6, 53.4, 55.4, 76.4, 121.3, 146.8; MS (ESI) calcd for C$_{17}$H$_{31}$O$_2$ [M+H]$^+$/z: 267.23. found: 267.58

Synthesis of 3,20-dimethoxy-pregn-4-ene (probe 5). Probe 5 was synthesized according to the synthetic route in FIG. 4C. Sodium borohydride (960 mg, 25.5 mmol) was added to the solution of progesterone 28 (2 g, 6.37 mmol) in methanol (25 mL) at 0° C. and stirred for 2 hrs at 0° C. The reaction was quenched with 10 mL ice-cold water. Methanol was removed under vacuum and the residue was extracted with CH$_2$Cl$_2$ (2×30 mL). The organic fraction was dried with anhydrous Na$_2$SO$_4$ and concentrated to provide compound 29 in quantitative yield. Under argon, to the solution of compound 29 (1.9 g, 6.01 mmol) in anhydrous THF (50 mL), NaH (60%, 0.62 g, 24.04 mmol) was added at 0° C. and stirred for 30 min followed by the addition of dimethyl sulfate (4.35 mL, 18.03 mmol). The mixture was refluxed for 12 hrs and cooled to 0° C. The reaction was quenched with saturated ammonium chloride solution (25 mL). THF was removed under vacuum and the residue was extracted with CH$_2$Cl$_2$ (3×20 mL). The collected organic portion was dried with Na$_2$SO$_4$ and concentrated. The crude product was purified by flash chromatography (hexanes/ethyl acetate: 12/1) to provide probe 5 (1.65 g, 80%) as a white solid. $^1$H NMR (500 MHz, CDCl$_3$): δ=0.73 (s, 3 H), 0.79 (m, 1 H), 0.92 (m, 1 H), 1.00 (s, 3H), 1.02 (m, 1 H), 1.08 (s, 3 H), 1.08-1.52 (m, 9 H), 1.67 (m, 2 H), 1.76 (m, 2 H), 1.99-2.14 (m, 3 H), 2.24 (m, 1 H), 3.23 (m, 1 H), 3.32 (s, 3 H), 3.40 (s, 3 H), 3.78 (m, 1 H), 5.37 (s, 1 H); $^{13}$C NMR (100 MHz, CDCl$_3$): δ=12.5, 17.7, 18.8, 20.9, 24.4, 25.2, 25.7, 32.3, 33.1, 35.2, 35.8, 37.6, 39.6, 42.4, 54.6, 55.3, 55.4, 55.5, 56.5, 76.4, 79.3, 120.4, 147.9; MS (ESI) calcd for C$_{23}$H$_{39}$O$_2$ [M+H]$^+$ m/z: 347.30. found: 347.62.

Construction of P450 Libraries. Site-saturation mutagenesis libraries were prepared using pCWori_FL#62 as template, primers 5'-GGAAACAGGATCCATCGATGC-3' and 5'-AATATCGAGCTCGTAGTTTGTATGATC-3' as megaprimers, and appropriate mutagenizing primers. The double site mutagenesis library 78NNK/87NNK was prepared by PCR overlap extension mutagenesis and SOEing using pCWori_RF#62 as template. Triple mutant libraries (78/81/87NNK, 78/87/181NNK, 78/87/184NNK) were prepared using the 78/87NNK library as template and the respective mutagenizing primers for position 81, position 181 and position 184. Quadruple site mutagenesis libraries (78/81/82/87NNK, 81/82/87/184NNK) were prepared through sequential rounds of mutagenesis, library pooling, followed by further mutagenesis. The SOE products (1.5 Kbp) were digested with BamH I and Sac I restriction enzymes and ligated to BamH I/Sac I double-digested pCWori_FL#62 vector. The ligation mixtures were transformed in chemically competent DH5a cells and plated on LB agar plates containing ampicillin at 100 μg/mL followed by overnight incubation at 37° C.

Expression and Fingerprinting of P450 Libraries in 96-Well Plates. 96-deep well plates containing 400 μL LB medium (100 mg ampicillin L-1) per well were inoculated with single colonies from the P450 libraries. The total number of screened P450 variants was about 10,000. In each plate, 8 wells were inoculated with the parent enzyme FL#62. After inoculation, the plates were shaken at 200 rpm and 37° C. for 16 hours. The LB plates were used to inoculate a second set of 96-deep well plates containing 900 μL TB medium. TB plates were incubated for at 37° C. and 200 rpm until the OD$_{600}$ reached 1.0, at which point cells were induced with 0.25 mM IPTG and 0.3 mM ALA. After induction, plates were incubated at 30° C. and 200 rpm for 18 hrs, followed by centrifugation at 3500 rpm, and stored at −80° C. after removal of the supernatant. Cell lysates were prepared by adding 400 μL lysis solution (4 U DNase 1,0.8 mg/mL lysozyme, 10 mM MgCl$_2$, 50 mM phosphate buffer, pH 7.5) to each well of the 96-well plates. After incubation for 70 min at 37° C., the plates were centrifuged at 4,000 rpm and the clarified lysate used for screening. P450 demethylation activity on probe 1-5 was measured in parallel reactions with the aid of a Beckman Coulter Multimek 96 automated pipettor and a TECAN Infinity plate reader. Reactions were carried out in 96-well microtiter plates by mixing 50 μL cell lysate with 150 μL 50 mM phosphate buffer (pH 7.5) containing the probe at 1 mM and a PTDH-based cofactor regeneration system (1.8 μM PTDH, 50 mM sodium phosphite, 150 μM NADP$^+$). After incubation for 1 hour at room temperature, plates were added with 50 μL 2 M NaOH containing 150 mM Purpald and the absorbance at 550 nm measured using the plate reader. The measured demethylation activity of each P450 variant on the five probes was then normalized to the activity of the parent enzyme FL#62 (SEQ ID NO 15) from the same plate. The resulting normalized fingerprints were then analyzed to identify the P450 variants in the libraries which exhibit a unique fingerprint, where the discriminating criterion was a difference larger than ±20% in at least one of the fingerprint components. Recombinant cells expressing the P450 variants with a unique fingerprint were isolated and arranged in 96-well plates containing FL#41 (SEQ ID NO 3) as reference P450. The P450 variants of this collection were fingerprinted as described above using the probe activity of FL#41 (SEQ ID NO 3) for fingerprint normalization.

6.3 Example 3

Identification of Substrate-reactive Monooxygenases Via Probe-target Molecule Molecular Similarity and Fingerprint Analysis This example illustrates the application of one embodiment of the method for enabling the rapid identification, within a library of fingerprinted monooxygenases, of those members that are catalytically active on a series of relevant target substrates. Specifically, this embodiment of the method involves the assessment of the molecular similarity between the target compound and the fingerprint probes followed by substrate-reactivity predictions via fingerprint analysis.

The 261 unique-fingerprint monooxygenase variants isolated in Example 2 were pooled to form a collection of fingerprinted P450 monooxygenases. Six different molecules, pentylcyclohexanol (6), menthol (7), borneol (8), camphorsultam (9), 11,12-dihydronootkatone (10), and sclareolide (11), were selected as target molecules. These are representatives of compounds of commercial value (e.g., as flavor: menthol, or fragrance: dihydronootkatone and borneol) and/or of practical value (e.g., for asymmetric catalysis: camphorsultam, menthol, borneol) for which oxyfunctionalized derivatives would be highly desirable.

In one embodiment, the molecular similarity of each of these target compounds and each of the fingerprint probes was calculated using the Maximal Common Substructure (MCS) algorithm in the form of molecular similarity indexes ($S_{MCS}$). Based on these analyses, 6 and 7 were determined to have highest molecular similarity to 1 ($S_{MCS}$: 0.92 and 0.73, respectively), 8 and 9 were determined to have highest molecular similarity to 2, ($S_{MCS}$: 0.92 and 0.57, respectively), and 10 and 11 were determined to have highest molecular similarity to 4 ($S_{MCS}$: 0.94 and 0.7, respectively). Accordingly, the P450s in the 261-member collection were ranked analyzing their fingerprints, where probe 1-activity was used as predictor for 6- and 7-reactivity, probe 2-activity as predictor for 8- and 9-reactivity, and probe 4-activity as predictor for 10- and 11-reactivity. The forty top-ranking P450s for each substrate were extracted from the collection and then tested for their ability to oxygenate the target compounds in order to validate the predictions. The oxygenation activity of the enzymes on the target compounds was determined carrying out in vitro reactions (~0.1 mol % P450 in KPi pH 8.0, 16 hr) and quantification of the total amount of oxygenation products produced in the reaction by GC analysis. Notably, activity predictions were confirmed in 85% to 100% of the cases (activity threshold value: 100 total turnovers, TTN), as summarized in FIG. 6. On average, 78% of the identified P450 variants were found to support more than 400 total turnovers (57%: >750 TTN; 30%: >1,000 TTN), indicating that the large majority of the identified P450 catalysts could be already useful for synthesis of oxyfunctionalized derivatives of the target compounds at preparative scale. The fingerprint-based substrate-reactivity predictions were further validated by characterizing ten bottom-ranking P450 variants for each of the target substrates. These enzymes were predicted to be inactive as their fingerprints indicated no activity on 1, 2 or 4, respectively. On average, 88% of these variants showed no detectable oxidation activity on the target substrate (FIG. 6), further demonstrating the reliability of the method.

These studies demonstrated the efficiency of one the methods disclosed herein to accelerate the discovery of synthetically useful monooxygenase catalysts for several structurally diverse target compounds (6-11) through simple molecular similarity calculations and fingerprint-based substrate-reactivity predictions. As shown in FIG. 6, the hit rate in finding a viable monooxygenase catalyst (TTN>100) for oxygenation of the target compounds was, on average, >90%. For comparison, the maximal hit rate achievable using a traditional approach involving one-by-one screening of the members of the original FL#62-based library (Example 2) against each of the target compounds, would have been 15%. This estimate assumes that all the functional variants in the library are also substrate-reactive toward the target compound of interest, which, in practice, almost never happens.

Experimental Details for Example 3

P450 Activity Predictions on Substrates 6-11 and In Vitro Activity Measurements. P450 activity predictions towards 6 and 7 were carried out by ranking the normalized fingerprints of the 261-member P450 collection based on component 1 (=corresponding to activity on probe 1) from high to low. Forty of the top-ranking P450 variants (=predicted to be most active in hydroxylating 6 and 7), and ten of the bottom-ranking variants (=predicted to be inactive on 6 and 7), were extracted from the collection, expressed in 96-well plates, and tested for activity on 6 and 7 as detailed below. An analogous procedure was applied for the P450 activity predictions on 8/9 and 10/11 with the difference that fingerprint ranking was in this case based on component 2 and component 4, respectively. The hydroxylation activity of the isolated P450s on the target substrates was determined through reactions using cell lysates from cultures grown in 96-deep well plates. 250 μL lysate was mixed with 250 μL 50 mM phosphate buffer (pH 7.5) containing the target substrate (final concentration: 1 mM) and the cofactor regeneration system (final concentrations: 1.8 μM PTDH, 50 mM $Na_2HPO_3$, 150 μM NADP+). P450 concentration in the cell lysate was determined using the CO-binding assay. Reactions were shaken for 16 hrs at room temperature, then added with 10 μL 50 mM guaiacol (internal standard), and extracted with 200 μL $CH_2Cl_2$. The organic fractions were analyzed on a Shimadzu GC-2010 using an Agilent HP5 column (30 m×0.32 mm×0.1 μm film), 1 μL injection, FID detector and the following separation method: 4-pentylcyclohexanol (6) (210° C. inlet, 260° C. detector, 120° C. oven, 12° C./min gradient to 200° C., 50° C./min gradient to 240° C., 240° C. for 1 min.); (−)-menthol (7) (260° C. inlet, 260° C. detector, 100° C. oven, 12° C./min gradient to 180° C., 50° C./min gradient to 240° C., 240° C. for 1 min.); (−)-borneol (8), (+)-camphorsultam (9) and 11,12-dihydronootkatone (10) (260° C. inlet, 260° C. detector, 120° C. oven, 12° C./min gradient to 220° C., 220° C. for 1 min., 20° C./min gradient to 250° C., 250° C. for 1 min.); sclareolide (11) (250° C. inlet, 300° C. detector, 130° C. oven, 12° C./min gradient to 200° C., 200° C. for 5 min., 100° C./min gradient to 300° C., 300° C. for 4 min.). Substrate activities were measured based on the total turnovers of the P450 variants on the target compounds 6-11 which were estimated based on the GC peak areas corresponding to the observed oxidation products.

6.4 Example 4

Identification of Monooxygenases with Different and Similar Reactivity to a Monooxygenase of Interest Via Fingerprint Comparative Analysis This example provides a demonstration of the utility of one embodiment of the method for reliably and rapidly identifying, via fingerprint analysis, monooxygenases that exhibit either different reactivity or similar reactivity properties compared to a monooxygenase of choice (referred to herein as "parent monooxygenase") from a library of fingerprinted monooxygenases.

As described in Example 3, analysis of individual fingerprint components (single fingerprint component analysis) was useful to predict substrate-reactivity in the monooxygenases variants, and specifically toward target substrates 6-11. We then envisioned that this step could be followed by inspection of the whole fingerprints for the predicted substrate-active variants as a means to anticipate differences in the site-selectivity properties of these enzymes (as compared to each other and to the parent monooxygenase FL#62 (SEQ ID NO 15). In monooxygenases, the regio/stereoselectivity of the oxidation reaction depends upon the orientation of the substrate above the catalytic center (e.g., the heme iron in P450 enzymes) prior to oxidative attack. This is influenced by the active site configuration of the monooxygenase, which can be mapped through the described fingerprinting approach. To prove the concept that fingerprint analysis can provide predictive information on the site-reactivity properties of the enzyme, we isolated P450 variants featuring divergent fingerprints (i.e., significantly different fingerprints) and compared their product distribution after reaction with 6-11 also with respect to the product distribution of the parent monooxygenase FL#62 (SEQ ID NO 15). With nearly all the tested compounds (5/6), P450s with different fingerprints exhibited also important differences in regioselectivity, as illustrated by the representative data in FIGS. 7A, 8A, and 9A. This occurred with a frequency of 43% (6), 32% (7), 42% (8), 41% (9), and 45% (10), indicating that a large fraction (~40% on average) of the active site changes captured by fingerprinting affected the binding mode of these substrates during catalysis.

To shed light on the sites targeted by oxygenation in 6-10, the major oxidation products were isolated from larger scale reactions (50 mg substrate, 0.2 mol % P450, 24 h) and their identity elucidated by 1D and 2D-NMR ($^1$H—$^1$H COSY, HMBC, HSQC, NOESY) (FIG. 10). The data corresponding to 8 (borneol) and 10 (11,12-dihydro-nootkatone) are of particular interest because they highlight two key aspects of the overall approach. First, the isolated P450 variants were found to target, collectively, 40% of the sp$^3$ C—H sites occurring in these compounds (3/7 and 4/10, respectively), including tertiary as well as less electronically activated secondary and primary positions (FIG. 10). The site-selectivity of these variants toward the different sites varied from 100% to about 10% (FIGS. 7B, 8B, and 9B). Overall, these results are remarkable considering the small pool of variants tested (40) and their straightforward identification through fingerprinting and fingerprint analysis. Another important finding was that P450-catalyzed hydroxylation in these substrates occurred also at positions which are remote with respect to the reporter functional group in the corresponding probe (e.g., products 13, 14, 19 in FIG. 10). These studies demonstrate the ability of the described fingerprint-based method not only to expedite the search of P450 oxidation catalysts with diversified regioselectivity but also to enable the discovery of P450s useful for targeting aliphatic positions across the whole carbon skeleton of terpenes structurally related to the fingerprint probes.

According to the premises and principles of our method, we anticipated that two variants sharing a similar fingerprint would display similar site-reactivity in substrate oxygenation. To illustrate this point, we isolated three variants (5-G9, 5-C4,5-C2) from the 78/81/87 library in Example 3, which shared an identical fingerprint (in this case, any of these variants can be considered as the "parent monooxygenase" for the other two). Characterization of these variants revealed that these enzymes exhibit remarkably similar or virtually identical product profiles across multiple substrates (FIGS. 11 and 12). DNA sequencing revealed that these P450s differ from each other by up to three amino acid substitutions in their active sites. Nevertheless, these mutations have clearly resulted in equivalent active site geometries, a feature that could be captured through analysis of their fingerprints. For comparison, another P450 variant was extracted from the same library (5-C12) and found to differ from 5-C4 by a single amino acid (V78 versus F78). Interestingly, this single amino acid substitution causes a remarkable change in the active site configuration of the enzyme as evinced from the difference in the product distribution with 7, 8, and 10 (FIG. 12) and as it could be anticipated from comparison of the respective fingerprints (FIG. 11).

These experiments illustrate another embodiment of the methods disclosed herein, that is, how the methods of fingerprint analysis disclosed herein can offer a convenient strategy to identify, within a library of fingerprinted monooxygenase, those that possess a similar or identical reactivity. This can be useful in several settings. For example, several natural monooxygenases are of great interest because of their role in the biosynthesis of biologically active natural products (e.g., plant biosynthetic P450s), yet they are unsuitable for large-scale (e.g., industrial scale) synthetic applications due to their membrane-bound structure, low solubility, and/or poor stability. This embodiment of the method can thus be useful to identify more robust, soluble, or easily obtainable monooxygenase catalysts (e.g., engineered variants of bacterial P450s) that exhibit very similar or identical reactivity to these monooxygenases of interest, thus serving as synthetically more useful "functional equivalents" of such monooxygenases. As another example, this method can be useful in protein engineering or directed evolution experiments where the goal is to improve a particular feature of the enzyme (e.g., thermostability, tolerance to organic solvent) but it is also desirable that the resulting engineered enzyme maintain or exhibit a specific type of reactivity. In this case, the screening of enzyme libraries for the feature to be improved can be coupled to fingerprint-driven identification of those monooxygenases that exhibit the desired reactivity properties.

Experimental Details for Example 4

Isolation and Identification of (−)-Borneol Oxidation Products. To isolate compounds 13, 14, and 16, a large scale reaction (250 mL) was set up with P450 mutant III-E7 (1 µM) in 50 mM phosphate buffer (pH 8.0) in the presence of (−)-borneol (38 mg, final conc.: 1 mM), PTDH at 2 µM, NADP at 150 µM, and sodium phosphite at 50 mM. The mixture was stirred overnight at room temperature. After removal of the enzyme through filtration, the filtrate was loaded on a C18 resin column and the hydroxylated products eluted with acetonitrile. The eluate was dried with $Na_2SO_4$, concentrated in vacuum, and purified by flash chromatography (dichloromethane/hexanes/ethyl acetate: 2/1/1) to afford 13 (6 mg), 14 (26 mg) and 16 (4 mg). To isolate compounds 12 and 15, a large scale reaction (250 mL) was set up with P450 mutant II-E1 (1 µM) in 50 mM phosphate buffer (pH 8.0) in the presence of (−)-borneol (38 mg, final conc.: 1 mM), PTDH at 2 µM, NADP at 150 µM, and sodium phosphite at 50 mM and stirred at room temperature overnight. The hydroxylated products were isolated by solid-phase extraction using a $C_{18}$ column as described above. The eluate was dried with $Na_2SO_4$, concentrated in vacuum, and purified by flash chromatography (dichloromethane/diethyl ether: 2/1) to afford a mixture (28 mg) of 12 and 15 in 3:1 ratio. Compound 13 ((2R,6R)-1-methyl-2-hydroxy-7,7-dimethyl-bicyclo[2,2,1]hept-6-ol). $^1$H NMR (500 MHz, CDCl$_3$): δ=0.84 (s, 6 H), 0.92-0.95 (dd, 1 H, J=12.8 Hz, J=3.2 Hz), 1.02 (s, 3 H), 1.79 (dd, 1 H, J=4.6 Hz, J=4.6 Hz), 1.84-1.89 (m, 1 H), 1.92-1.97 (dd, 1 H, J=12.6 Hz, J=7.6 Hz), 2.26-2.32 (m, 1 H), 4.09-4.12 (dd, 1 H, J=10 Hz, J=3.8 Hz), 4.37-4.39 (dd, 1 H, J=8.3 Hz, J=3.9 Hz). $^{13}$C NMR (100 MHz, CDCl$_3$): δ=9.0, 19.3, 21.0, 37.8, 41.0, 44.9, 47.3, 52.5, 69.5, 74.8; MS (ESI) calcd for C$_{10}$H$_{19}$O$_2$ [M+H]$^+$/z: 171.14. found: 171.18. Compound 14 ((1S,2R,5S)-1-methyl-2-hydroxy-7,7-dimethyl-bicyclo[2,2,1]hept-5-ol). $^1$H NMR (500 MHz, CDCl$_3$): δ=0.80-0.97 (m, 7 H), 1.16 (s, 3 H), 1.44 (d, 1 H, J=13.8 Hz), 1.76 (d, 1 H, J=5.1 Hz), 2.33 (m, 1H), 2.41 (dd, 1H, J=13.8 Hz, J=7.8 Hz), 3.92-3.97 (m, 2 H); $^{13}$C NMR (100 MHz, CDCl$_3$): δ=12.4, 19.3, 20.8, 36.1, 38.4, 47.2, 46.9, 53.0, 74.4, 74.6; MS (ESI) calcd for C$_{10}$H$_{19}$O$_2$ [M+H]$^+$/z: 171.14. found: 171.26. Compound 16 ((1S,2R)-1-hydroxymethyl-2-hydroxy-7,7-dimethyl-bicyclo-[2,2,1]heptanes). $^1$H NMR (500 MHz, CDCl$_3$): δ=0.96 (s, 3 H), 0.98 (s, 3 H), 1.02-1.05 (dd, 1 H, J=11.8 Hz, J=3.3 Hz), 1.33-1.50 (m, 2 H), 1.68 (dd, 1 H, J=4.6 Hz, J=4.6 Hz), 1.83-1.91 (m, 1 H), 2.3-2.4 (m, 2 H), 3.75 (d, 1 H, J=10.6 Hz), 3.8 (d, 1H, J=10.6 Hz), 4.49-4.53 (m, 1H). $^{13}$C NMR (100 MHz, CDCl$_3$): δ=19.2, 20.6, 22.7, 28.0, 29.6, 33.7, 38.4, 46.1, 66.4, 75.3; MS (ESI) calcd for C$_{10}$H$_{19}$O$_2$ [M+H]$^+$/z: 171.14. found: 171.22. Compound 12 ((1S,2R)-1-methyl-2-hydroxy-7,7-dimethyl-bicyclo[2,2,1]hept-6-one). $^1$H NMR (500 MHz, CDCl$_3$): δ=0.98 (s, 3 H), 1.01 (s, 3 H), 1.07 (s, 3 H), 1.33-1.37 (dd, 1 H, J=14.4 Hz, J=3.68 Hz), 1.93-1.97 (m, 1 H), 2.19 (d, 1 H, J=5.8 Hz), 2.53-2.59 (m, 1 H), 2.66-2.69 (d, 1 H, J=18.5 Hz), 4.27-4.30 (ddd, 1 H, J=9.3 Hz, J=3.7 Hz, J=1.7 Hz). $^{13}$C NMR (100 MHz, CDCl$_3$): δ=12.6, 17.5, 20.6, 33.6, 40.8, 47.3, 50.3, 60.1, 75.1, 216.6; MS (ESI) calcd for C$_{10}$H$_{17}$O$_2$ [M+H]$^+$/z: 169.12. found: 169.28. Compound 15 ((1S,2R)-1-methyl-2-hydroxy-7,7-dimethyl-bicyclo[2,2,1]hept-5-one). $^1$H NMR (500 MHz, CDCl$_3$): δ=0.84 (s, 3 H), 1.03 (s, 3 H), 1.04 (s, 3 H), 1.36-1.40 (dd, 1 H, J=14.6 Hz, J=3.52 Hz), 2.02-2.03 (d, 1 H, J=18.5 Hz), 2.23 (dd, 1 H, J=2.4 Hz, J=2.4 Hz), 2.45-2.51 (m, 1 H), 2.53-2.63 (m, 1 H), 4.21-4.24 (m, 1 H); $^{13}$C NMR (100 MHz, CDCl$_3$): δ=15.9, 19.7, 25.6, 37.6, 38.8, 43.5, 44.2, 56.5, 75.8, 201; MS (ESI) calcd for C$_{10}$H$_{17}$O$_2$ [M+H]$^+$/z: 169.12. found: 169.24.

Isolation and Identification of (+)-camphorsultam Oxidation Products. To isolate compounds 17, a large scale reaction (250 mL) was set up with P450 mutant III-H2 (2 μM) in 50 mM phosphate buffer (pH 8.0) in the presence of (+)-10,2-camphorsultam (54 mg, final conc.: 1 mM), PTDH at 2 μM, NADP at 150 μM, and sodium phosphite at 50 mM. The mixture was stirred overnight at room temperature. After removal of the enzyme through filtration, the filtrate was loaded on a C18 resin column and the hydroxylated products eluted with acetonitrile. The eluate was dried with Na$_2$SO$_4$, concentrated in vacuum, and purified by flash chromatography (gradient from 10 to 40% ethyl acetate in hexanes) to afford 17 (32 mg). Compound 17 (camphorsulfonimine). $^1$H NMR (500 MHz, CDCl$_3$): δ=0.92 (s, 3 H), 1.13 (s, 3 H), 1.50 (m, 1 H), 1.83 (m, 1 H), 2.07-2.15 (m, 2 H), 2.30 (m, 1 H), 2.43 (d, 1 H, J=18.8 Hz), 2.82 (m, 1 H), 3.02 (d, 1 H, J=13.2 Hz), 3.23 (d, 1 H, J=13.2 Hz); $^{13}$C NMR (100 MHz, CDCl$_3$): δ=18.9, 19.4, 26.6, 28.3, 35.9, 44.5, 47.9, 49.4, 64.5, 195.1; MS (ESI) calcd for C$_{10}$H$_{16}$NO$_2$S [M+H]$^+$/z: 214.09. found: 214.42.

Isolation and Identification of 11,12-Dihydronootkatone Oxidation Products. To isolate 18, 19, and 20, a large scale reaction (250 mL) was set up with P450 mutant II-B4 (2 μM) in 50 mM phosphate buffer (pH 8) in the presence of 11,12-dihydronootkatone (63 mg, final conc.: 1 mM), PTDH at 2 μM, NADP at 150 μM, and sodium phosphite at 50 mM. The reaction mixture was stirred overnight at room temperature. The hydroxylated products were isolated by solid-phase extraction using a C$_{18}$ column and eluted with acetonitrile. The eluate was dried with Na$_2$SO$_4$, concentrated in vacuum, and purified by flash chromatography (from hexanes/ethyl acetate: 10/1 to dichloromethane/hexanes/ethyl acetate: 2/2/1) to afford 18 (4 mg), 19 (10 mg), 20 (18 mg), and unreacted 11,12-dihydronootkatone (25 mg recovered). To isolate 21, a large scale reaction (130 mL) was set up with P450 mutant II-D4 (2 μM) in 50 mM phosphate buffer (pH 8.0) in the presence of 11,12-dihydronootkatone (31 mg, final conc.: 1 mM), PTDH at 2 μM, NADP at 150 μM, and sodium phosphite at 50 mM. The reaction mixture was stirred overnight at room temperature. The hydroxylated product was isolated by solid-phase extraction using a C$_{18}$ column and eluted with acetonitrile. The eluate was dried with Na$_2$SO$_4$, concentrated in vacuum, and purified by flash chromatography (from hexanes/ethyl acetate: 10/1 to dichloromethane/hexanes/ethyl acetate: 2/2/1) to afford 21 (15 mg). Compound 18 ((3S,4S,6R,10S)-3-hydroxy-4,10-dimethyl-6-isopropyl-1-en-3,4,5,6,7,8-hexahydronaphthalen-2-one). $^1$H NMR (500 MHz, CDCl$_3$): δ=0.93-0.96 (m, 9 H), 1.08-1.16 (m, 1 H), 1.28 (s, 3 H), 1.44-1.50 (m, 1 H), 1.65-1.80 (m, 3 H), 2.05-2.12 (m, 2 H), 2.28-2.32 (m, 1 H), 2.50-2.57 (ddd, 1 H, J=13.6 Hz, J=13.5 Hz, J=1.2 Hz), 4.45 (d, 1 H, J=5.0 Hz), 5.88 (d, 1 H, J=1.1 Hz); $^{13}$C NMR (100 MHz, CDCl$_3$): δ=8.7, 20.0, 20.2, 22.8, 29.7, 32.5, 33.1, 38.6, 41.2, 42.5, 44.0, 73.1, 119.4, 171.9, 200.1; MS (ESI) calcd for C$_{15}$H$_{25}$O$_2$ [M+H]$^+$/z: 237.19. found: 237.43. Compound 19 ((4R,6S,8R,10S)-8-hydroxy-4,10-dimethyl-6-isopropyl-1-en-3,4,5,6,7,8-hexahydronaphthalen-2-one). $^1$H NMR (500 MHz, CDCl$_3$): δ=0.95-1.04 (m, 7 H), 1.28 (s, 3 H), 1.33 (s, 3 H), 1.35-1.41 (m, 1 H), 1.52-1.6 (m, 1 H), 1.91-1.96 (m, 1 H), 1.99-2.08 (m, 3 H), 2.28-2.43 (m, 2 H), 4.48 (dd, 1 H, J=2.7 Hz, J=3.0 Hz), 5.90 (s, 1 H); $^{13}$C NMR (100 MHz, CDCl$_3$): δ=14.6, 18.2, 19.5, 19.7, 32.1, 32.5, 36.1, 38.7, 41.3, 41.8, 42.4, 73.7, 127.0, 169.2, 200.7; MS (ESI) calcd for C$_{15}$H$_{25}$O$_2$ [M+H]$^+$/z: 237.19. found: 237.23. Compound 20 ((4R,6R,10S)-4,10-dimethyl-6-(1'-hydroxyisopropyl)-1-en-3,4,5,6,7,8-hexahydronaphthalen-2-one). $^1$H NMR (500 MHz, CDCl$_3$): δ=1.01-1.07 (m, 4 H), 1.13 (s, 3 H), 1.24-1.30 (m, 7 H), 1.76 (m, 1 H), 2.03-2.11 (m, 3 H), 2.25-2.56 (m, 4 H), 5.78 (s, 1 H); $^{13}$C NMR (100 MHz, CDCl$_3$): δ=14.9, 16.9, 26.9, 27.4, 27.7, 32.9, 39.2, 39.7, 40.6, 42.1, 43.9, 72.5, 125.0, 171.0, 199.8; MS (ESI) calcd for C$_{15}$H$_{25}$O$_2$ [M+H]$^+$/z: 237.19. found: 237.30. Compound 21 ((4R,6R,10S)-4,10-dimethyl-6-(1'-hydroxymethylethyl)-1-en-3,4,5,6,7,8-hexahydronaphthalen-2-one). $^1$H NMR (500 MHz, CDCl$_3$): δ=0.93 (d, 3H, J=7.1 Hz), 0.96 (m, 4 H), 1.09 (s, 3 H), 1.12-1.22 (m, 2 H), 1.83 (m, 1 H), 1.87 (m, 1 H), 1.91 (m, 1 H), 1.99 (m, 1 H), 2.22 (m, 1 H), 2.29 (dd, 1 H, J=14.0 Hz, J=17.3 Hz), 2.35 (m, 1 H), 2.48 (m, 1 H), 3.55 (dd, 1 H, J=6.3 Hz, J=10.4 Hz), 3.63 (dd, 1 H, J=5.8 Hz, J=10.4 Hz), 5.75 (br s, 1 H); $^{13}$C NMR (100 MHz, CDCl$_3$): δ=13.6, 15.0, 16.9, 30.7, 33.1, 34.3, 39.2, 40.2, 40.5, 41.3, 42.1, 65.9, 124.5, 171.1, 199.7; MS (ESI) calcd for C$_{15}$H$_{25}$O$_2$ [M+H]$^+$/z: 237.19. found: 237.27.

Isolation and Identification of (−)-Menthol Oxidation Products. To isolate compounds 22 and 23, a large scale reaction (250 mL) was set up with P450 mutant II-E12 (1 μM) in 50 mM phosphate buffer (pH 8.0) in the presence of (−)-menthol (39 mg, final conc.: 1 mM), PTDH at 2 μM, NADP at 150 μM, and sodium phosphite at 50 mM and stirred at room temperature overnight. The reaction mixture was stirred overnight at room temperature. The hydroxylated product was isolated by solid-phase extraction using a C$_{18}$ column and eluted with acetonitrile. The eluate was dried with Na$_2$SO$_4$, concentrated in vacuum, and purified by flash chromatography (dichloromethane/hexanes/ethyl acetate: 1/1/1) to afford 22 (14 mg) and 23 (21 mg). Compound 22 ((1S,2R,3S,6R)-2-hydroxy-3-isopropyl-6-methyl-cyclohexanol). $^1$H NMR (500 MHz, CDCl$_3$): δ=0.87 (d, 3 H, J=7.0 Hz), 0.97-1.01 (m, 4 H), 1.06 (d, 3 H, J=7.0 Hz), 1.29-1.38 (m, 2 H), 1.42-1.46 (m, 1 H), 1.54-1.65 (m, 2 H), 2.11-2.17 (m, 1 H), 3.41-3.43 (dd, 1 H, J=10.9 Hz, J=3.03 Hz), 3.84 (dd, 1 H, J=2.4 Hz, J=2.4 Hz); $^{13}$C NMR (100 MHz, CDCl$_3$): $\delta$=15.9, 17.9, 20.9, 22.7, 25.7, 27.2, 35.6, 42.3, 73.7, 74.9; MS (ESI) calcd for C$_{10}$H$_{21}$O$_2$ [M+H]$^+$/z: 173.15. found: 173.24. Compound 23 ((1R,2S,5R)-2-(1'-hydroxyisopropyl)-5-methyl-cyclohexanol). $^1$H NMR (500 MHz, CDCl$_3$): $\delta$=0.91-0.96 (m, 5 H), 1.06 (m, 1 H), 1.24 (s, 6 H), 1.38-1.49 (m, 2 H), 1.65-1.74 (m, 2 H), 1.96 (m, 1 H), 3.73 (ddd, 1 H, J=10.6 Hz, J=10.6 Hz, J=4.3 Hz); $^{13}$C NMR (100 MHz, CDCl$_3$): $\delta$=21.9, 23.6, 27.0, 30.0, 31.3, 34.6, 44.6, 53.3, 72.9, 75.1; MS (ESI) calcd for C$_{10}$H$_{21}$O$_2$ [M+H]$^+$/z: 173.15. found: 173.32.

Isolation and Identification of Sclareolide Oxidation Product. To isolate compounds 24, a large scale reaction (250 mL) was set up with P450 mutant II-H8 (1 μM) in 50 mM phosphate buffer (pH 8.0) in the presence of sclareolide (56 mg, final conc.: 1 mM), PTDH at 2 μM, NADP at 150 μM, and sodium phosphite at 50 mM and stirred at room temperature overnight. The reaction mixture was stirred overnight at room temperature. The hydroxylated product was isolated by solid-phase extraction using a C$_{18}$ column and eluted with acetonitrile. The eluate was dried with Na$_2$SO$_4$, concentrated in vacuum, and purified by flash chromatography (from hexanes/dichloromethane/ethyl acetate: 1/1/1) to afford 24 (50 mg). Compound 24 ((S)-3-hydroxy sclareolide). $^1$H NMR (500 MHz, CDCl$_3$): $\delta$=0.84 (s, 3 H), 0.96 (s, 3 H), 1.04 (s, 3 H), 1.07 (m, 1 H), 1.23 (m, 1 H), 1.37 (m, 3 H), 1.46-1.52 (m, 2 H), 1.65-1.76 (m, 4 H), 1.92-1.98 (m, 2 H), 2.13 (m, 1 H), 2.27 (dd, 1 H, J=16.4 Hz, J=6.4 Hz), 2.45 (dd, 1 H, J=16.4 Hz, J=15.8 Hz), 3.29 (dd, 1 H, J=11.6 Hz, J=5.3 Hz); $^{13}$C NMR (100 MHz, CDCl$_3$): $\delta$=15.0, 15.1, 20.3, 21.5, 26.8, 27.9, 28.7, 35.7, 37.7, 38.4, 38.8, 55.3, 58.9, 78.6, 86.1, 176.8; MS (ESI) calcd for C$_{16}$H$_{27}$O$_3$ [M+H]$^+$/z: 267.20. found: 267.41.

6.5 Example 5

Identification of Monooxygenases that Exhibit a Desired Substrate-reactivity Property (Artemisinin-reactivity) Via Fingerprint-based Trained Predictions This example demonstrates an exemplary application of one the methods provided herein to guide and accelerate the identification of monooxygenases that exhibit a desired substrate-reactivity property, namely the ability to accept the plant-derived natural product artemisinin (ART, FIG. 14A), a valuable antimalarial drug, as substrate for oxygenation. This example also illustrates how this method is suitable for correctly predicting, via fingerprint analysis and trained predictions, monooxygenase reactivity toward a complex molecule structurally unrelated to the fingerprint probes.

ART is a tricyclic sesquiterpene lactone extracted from the plant A. annua that is of high value as antimalarial agent. Because of its peculiar hydrocarbon scaffold, the molecular similarity of ART versus any of the fingerprint probes 1-5 is low ($S_{MCS}$<0.25). This makes the application of the monooxygenase reactivity prediction approach based on trained predictions a more suitable strategy for the identification of ART-oxygenating catalysts as compared to the method based on single fingerprint component analysis described in Example 3.

Initial experiments revealed that FL#62 (SEQ ID NO: 15) was active on ART (340 total turnovers) producing C7(S)—, C7(R)—, and C6α-hydroxy-ART (FIG. 14A) in 83:10:7 ratio. Additional 5,000 FL#62-derived variants were produced by simultaneous active-site mutagenesis and subjected to high throughout fingerprinting as described in Example 2. From the acquired fingerprint data, 259 functionally diverse variants (i.e., with a unique fingerprint) were isolated according to the procedure described in Example 2 and combined with the previously isolated 261 variants (Example 2), to yield a collection of 520 functionally diverse, fingerprinted monooxygenases. From this pool, twenty monooxygenases were randomly isolated to serve as the training set for generating a fingerprint model predictive of ART-reactivity and ranking the members of the monooxygenase library according to this reactivity property, as schematically illustrated in FIG. 13. The ART oxygenation activity of the training set P450s was characterized by LC-MS analysis of reactions with ART and each of these variants and quantified in terms of total turnovers (TTN). Out of the 20 training set P450s, 6 (30%) showed to be active on ART (threshold: >50 TTN), while the remainder were inactive. The fingerprints of the training set P450s (both ART-reactive and ART-unreactive) were then correlated with the measured ART activities (TTN values) by multiple linear regression (MLR) analysis, where ART activity is the dependent variable, Y, and the five components of their fingerprints (corresponding to the normalized activities on probes 1-5) are five independent variables ($x_1$, $x_2$, $x_3$, $x_4$, $x_5$) potentially correlated with Y. This process yielded best-fit regression coefficients for the training set and a candidate fingerprint-based model (Y=0.44$x_1$+0.52$x_2$+ 0.44$x_3$+0.72$x_4$+0.47$x_5$) predictive of ART-reactivity. Using this model, the remaining P450s in the 520-member collection of fingerprinted P450s were ranked (from highest to lowest predicted ART-reactivity). The 50 top-ranking variants as well as the 20 bottom-ranking variants were then tested experimentally in order to validate the predictions. Notably, 90% (45/50) of the predicted ART-reactive P450s (top-ranking) showed ART activity (threshold: >50 TTN, FIG. 14B), while 80% (16/20) of the predicted ART-unreactive P450s (bottom-ranking) showed no detectable activity on this compound, confirming the reliability of the predictions and supporting the viability of the overall method. Noteworthy was also that 44% (22/50) of the predicted ART-reactive P450s were able to support more ART turnovers than the parental sequence (FL#62) from which they were derived, with one (II-C3) exhibiting almost 2-fold higher total turnovers (602 vs. 339 TTN) (FIG. 14B).

Experimental Details for Example 5

Isolation and Identification of ART Hydroxylation Products. A preparative-scale ART hydroxylation reaction (150 mg ART) was carried out using purified P450 variant FL#62 (1 μM) in 1 L phosphate buffer (50 mM, pH 8.0), and PTDH at 2 μM, NADP at 150 μM, and sodium phosphite at 50 mM. The reaction mixture was stirred overnight at room temperature. The hydroxylated products were extracted with dichloromethane (3×100 mL). The collected organic layers were dried with Na$_2$SO$_4$, concentrated in vacuum, and purified by flash chromatography (dichloromethane/hexanes/ethyl acetate: 1/1/1.5) to afford the three hydroxylated products (C7(S)—, C7(R)—, and C6α-hydroxy-ART, FIG. 14A) in 83:10:7 ratio. (S)-7-hydroxy-artemisinin. $^1$H NMR (500 MHz, CDCl$_3$): $\delta$=1.18 (d, 3 H, J=7.2 Hz), 1.23 (m, 1 H), 1.27 (d, 3 H, J=7.2 Hz), 1.44 (m, 1 H), 1.50 (s, 3 H), 1.57 (m, 2 H), 1.79 (br, OH), 1.95 (m, 1H), 2.02-2.20 (m, 3H), 2.48 (m, 1 H), 3.32 (ddd, 1 H, J=10.6 Hz, J=10.6 Hz, J=4.5 Hz), 3.42 (m, 1 H), 5.98 (s, 1 H); $^{13}$C NMR (100 MHz, CDCl$_3$): $\delta$=12.6, 15.5, 24.8, 25.1, 32.1, 32.6, 35.8, 42.3, 44.5, 47.9, 73.5, 78.8, 93.5, 105.5, 171.6; MS (ESI) calcd for C$_{15}$H$_{23}$O$_6$ [M+H]$^+$/z: 299.15. found: 299.47. (R)-7-hydroxy-artemisinin. $^1$H NMR (500 MHz, CDCl$_3$): $\delta$=1.12 (d, 3 H, J=6.7 Hz), 1.23 (d, 3 H, J=7.3 Hz), 1.34 (dd, 1 H, J=13.7 Hz, J=2.1 Hz), 1.46-1.51 (m, 4 H), 1.56 (m, 1 H), 1.81 (br, OH), 1.95 (m, 2 H), 2.10 (m, 2 H), 2.40-2.53 (m, 2 H), 3.45 (m, 1 H), 3.89 (ddd, 1 H, J=2.8 Hz, J=2.8 Hz, J=2.5 Hz), 5.90 (s, 1 H); $^{13}$C NMR (100 MHz, CDCl$_3$): δ=12.5, 15.8, 24.6, 25.2, 30.7, 32.4, 36.0, 37.6, 41.3, 43.4, 69.1, 79.3, 93.4, 105.5, 172.4; MS (ESI) calcd for C$_{15}$H$_{23}$O$_6$ [M+H]$^+$/z: 299.15. found: 299.41. 6a-hydroxy-artemisinin. $^1$H NMR (500 MHz, CDCl$_3$): δ=1.15 (m, 1 H), 1.26 (d, 3 H, J=6.6 Hz), 1.36 (m, 1 H), 1.49 (s, 3 H), 1.56 (m, 1H), 1.54-1.61 (m, 2 H), 1.65 (br, OH), 1.76-1.85 (m, 2 H), 1.95-2.14 (m, 3 H), 2.50 (ddd, 1 H, J=17.3 Hz, J=13.3 Hz, J=3.9 Hz), 3.45 (m, 1 H), 3.68 (dd, 1 H, J=10.6 Hz, J=5.6 Hz), 3.79 (dd, 1 H, J=10.6 Hz, J=3.0 Hz), 5.93 (s, 1H); $^{13}$C NMR (100 MHz, CDCl$_3$): δ=12.6, 23.0, 24.5, 25.2, 27.9, 32.9, 35.9, 44.2, 44.5, 44.8, 64.1, 79.5, 93.6, 105.4, 172.0; MS (ESI) calcd for C$_{15}$H$_{23}$O$_6$ [M+H]$^+$/z: 299.15. found: 299.39.

Measurement of Monooxygenase Activity on Artemisinin (ART). These isolated ART hydroxylation products were used as standards to generate calibration curves for quantifying ART-hydroxylation activity of FL#62 and the other monooxygenases. This activity was measured as total turn-overs via quantification of the hydroxylation products from enzymatic reactions via derivatization with benzoyl chloride followed by HPLC analysis. Briefly, after the enzymatic reaction (0.5 mM ART, 1 μM P450 variant (purified or in cell lysate); 2 μM phosphate dehydrogenase, 100 μM NADP$^+$, 50 mM phosphoric acid), the mixture was added with 9-fluorenone as internal standard (0.5 mM) and extracted with dicholoromethane (0.2 mL). After removing the solvent, the residue was added with 0.1 mL dichloromethane, benzoyl chloride (5 equiv.), and DMAP (10 equiv.) for 3 hours at room temperature. The derivatized products (benzoyl esters) were analyzed using an Agilent 1200 UPLC. Analytical condition: Agilent XDB-C18 column (1.8 um, 4.4×50 mm); UV wavelength: 230 nm; Solvent A: 1% trifluoroacetic acid in deionized H$_2$O; Solvent B: 1% formic acid in acetonitrile. gradient condition: 0-1 min: 20% B; 1-8 mins: 20% B to 90% B; 8-10 mins: 90% B; 8-10.3 min: 90% B to 20% B; 10.3-11.3 min: 20% B. Flow rate: 0.8 mL/min. The area under the curve (AUC) corresponding to the ART hydroxylated products were normalized to the internal standard AUC and used to quantify these products using the calibration curves. Total turnover numbers were calculated from number of mol hydroxylation products/mol enzyme.

6.6 Example 6

Identification of Monooxygenases that Exhibit a Desired Site-reactivity Property (Regio- and Stereoselectivity for (S)—C7 ART Hydroxylation) Via Fingerprint-based Trained Predictions This example demonstrates an exemplary application of one the methods provided herein to guide and accelerate the identification of monooxygenases that exhibit a desired site-reactivity property. In this example, the site-reactivity property of interest is the ability of a monooxygenase to hydroxylate artemisinin with high regio-(C7 position) and S-stereoselectivity.

To generate a fingerprint-based model predictive of this site-reactivity property, a procedure similar to that described in Example 5 was carried out, with the difference that the reactivity property correlated with the fingerprints within the monooxygenase training set was the relative site-selectivity for the desired position (i.e., hydroxylation of C7 carbon atom in ART with S-stereoselectivity). For example, for P450 variant FL#62, which produces C7(S)—, C7(R)—, and C6a-hydroxy-ART in a 83:10:7 ratio, the corresponding site-selectivity value used for the fingerprint-site reactivity correlation analysis was 0.83 (=83% selectivity for the desired site). For this experiment, the same training set of 20 randomly chosen fingerprinted monooxygenases described in Example 5 was used. The site-selectivity for (S)—C7 ART hydroxylation for the ART-hydroxylating variants was quantified according to the procedure described in Example 5 (i.e. derivatization of hydroxylated products with benzoyl chloride followed by HPLC). The measured site-selectivity values ranged from a maximum of 0.83 (FL#62 variant) to 0.1 for the least (S)—C7 selective variant. For the 14 ART-inactive monooxygenase variants within the training set (see Example 5), the site-selectivity value was set to zero. According to one general method of the invention (schematically illustrated in FIG. 13), the fingerprints of the training set P450s were correlated with the measured site-selectivity by multiple linear regression (MLR) analysis, where ART (S)—C7 site-selectivity is the dependent variable, Y, and the five components of their fingerprints (corresponding to the normalized activities on probes 1-5) are five independent variables ($x_1$, $x_2$, $x_3$, $x_4$, $x_5$) potentially correlated with Y. This process yielded a candidate fingerprint-based model predictive of ART (S)—C7 site-selectivity, which was then used to rank the remaining P450s in the 520-member collection of fingerprinted P450s. The 10 top-ranking variants were then tested experimentally and their regio- and stereoselectivity in ART hydroxylation measured via HPLC analysis. Notably, 9 out of the 10 variants exhibited >60% selectivity for the desired site (FIG. 15), with only one being ART-unreactive. Even more notably, 2 out the 8 variants exhibited higher (S)—C7 site-selectivity in ART hydroxylation than the parental enzyme (=FL#62) from which they were derived and any of the monooxygenases in the training set. More, one of these two variants (1-A1, FIG. 15 exhibits 100% regio- and stereoselectivity for the desired site. These exemplary results illustrate the power of the method toward (a) enabling the rapid identification of monooxygenases with fine-tuned regio- and stereoselectivity, and (b) requiring minimal screening efforts (and consumption of valuable target compound) to achieve this goal. Also, this entire process did not require any prior or posterior knowledge of the amino acid sequence of any of the monooxygenases (both in the training set and those isolated through the fingerprint-based predictions). In other words, the information encoded in the fingerprints are sufficient for making reliable predictions regarding the reactivity properties of the fingerprinted monooxygenases as illustrated in this and the previous examples.

Experimental Details for Example 6. Technical procedures utilized for the experiments of this example are essentially the same as those described in Example 5 (e.g., procedures for determination of regio- and stereoselectivity in ART hydroxylation).

6.7 Example 7

Construction of Functionally Diverse Monooxygenase Libraries Driven by Fingerprint Analysis This example demonstrates an exemplary application of one the methods provided herein to guide the construction of engineered monooxygenase libraries enriched in functionally diverse variants (i.e. variants with diversified reactivity properties. As illustrated in the previous examples, the fingerprinting and fingerprint analysis methods disclosed herein allow one to identify and enumerate the members within a monooxygenase library that exhibit diversified reactivity properties (both in terms of substrate-reactivity and in terms of site-reactivity), as judged by their uniqueness of their fingerprint (compared to the parent enzyme as well as compared to any other member of the library). This capability can be exploited to assess the "functional diversity content" of a monooxygenase library as defined, for example, by the numbers of library member with a unique fingerprint. Whenever this library is produced through a particular mutagenesis event (e.g. site-saturation mutagenesis of a particular amino acid position within the enzyme sequence), this method allows to quantify the "functional diversity-generating potential" of such mutagenesis event as well as compare this potential to that of a different mutagenesis event. In this manner, it is possible to rank different mutagenesis events according to their functional diversity-generating potential and use these information to guide the construction of subsequent monooxygenase libraries with high functional diversity content.

To illustrate this aspect of the invention, single mutant libraries were constructed by NHT-mutagenesis of active site residues A74, F181, A184, L188, and A328 in P450 FL#62 (SEQ ID NO:15). An equal number of recombinants (50) from each library were arrayed and expressed in 96-well plates and fingerprinted with probes 1-5 according to the procedures described in the previous examples. As illustrated in FIG. 16A, fingerprint comparative analysis revealed different fractions of functionally diverse variants (i.e. variants with a unique fingerprint) in each library, that is resulting from each of the five distinct mutagenesis events. This is due to the fact that different amino acid positions in the enzyme have varying degrees of tolerance to mutagenesis, although this degree is hard to predict. According to a method of the invention, this fraction of functionally diverse variants was used as a measure of the functional diversity-generating potential for each of the five mutagenesis events considered in this experiment. Accordingly, these mutagenesis events were ranked as follows: 188NHT (highest priority)>74NHT>181NHT>184NHT>328NHT (lowest priority). Triple mutant libraries were then constructed by randomizing these positions (NHT) in a common background given by NHT randomization of positions 78 and 87. As the data in FIG. 16B indicates, the libraries prepared using high-priority mutagenesis events (188NHT and 74NHT) contained up to 3-fold larger fractions of functionally diverse variants as compared to those created using lower priority positions (181NHT and 184NHT), illustrating how this method can be used to guide the construction of engineered monooxygenase libraries enriched in functionally diverse variants.

The present invention is not to be limited in scope by the specific embodiments described herein. Indeed, various modifications of the invention in addition to those described herein will become apparent to those skilled in the art from the foregoing description. Such modifications are intended to fall within the scope of the appended claims.

All references cited herein are incorporated herein by reference in their entirety and for all purposes to the same extent as if each individual publication, patent or patent application was specifically and individually indicated to be incorporated by reference in its entirety for all purposes.

The citation of any publication is for its disclosure prior to the filing date and should not be construed as an admission that the present invention is not entitled to antedate such publication by virtue of prior invention.

SEQUENCE LISTING (151 sequences)

SEQ ID NO: 1 - protein, 1049 aa, Bacillus megaterium [sequence omitted]

SEQ ID NO: 2 - protein, 1049 aa, Artificial Sequence
  Synthesized sequence
MTIKEMPQPKTFGELKNLPLLNTDKPVQALMKIADELGEIFKFEAPGRVTRYLSSQRLIKEACDESRFDKNLSQALKFVRDFAGDGLATSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 3 - protein, 1049 aa, Artificial Sequence; identical to SEQ ID NO: 2
  Synthesized sequence

SEQ ID NO: 4 - protein, 1049 aa, Artificial Sequence
  Synthesized sequence
MTIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTVPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 5 - protein, 1049 aa, Artificial Sequence
  Synthesized sequence
MTIKEMPQPKTFGELKNLPLLNTDKPVQALMKIADELGEIFKFEAPGRVTRYLSSQRLIKEACDESRFDKNLSQALKFARDFAGDGLFTSWTHEKNWKKAHNILLPSFSQQAMKGYHAMMVDIAVQLVQKWERLNADEYIEVPEDMTRLTLDTIGLCGFNYRFNSFYRDQPHPFIISMIRALDEVMNKLQRANPDDPAYDENKRQFQEDIKVMNDLVDKIIADRKASGEQSDDLLTQMLNGKDPETGEPLDDGNISYQIITFLIAGHETTSGLLSFALYFLVKNPHVLQKVAEEATRVLVDPVPSYKQVKQLKYVGMVLNEALRLWPTAPAFSLYAKEDTVLGGEYPLEKGDEVMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 6 - protein, 1049 aa, Artificial Sequence
  Synthesized sequence
MTIKEMPQPKTFGELKNLPLLNTDKPVQALMKIADELGEIFKFEAPGRVTRYLSSQRLIKEACDESRFDKNLSQALKAVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFIISMVRALDEVMNKLQRANPDDPAYDENKRQCQEDIKVMNDLVDKIIADRKARGEQSDDLLTQMLNGKDPETGEPLDDGNISYQIITFLIAGHETTSGLLSFALYFLVKNPHVLQKVAEEAARVLVDPVPSYKQVKQLKYVGMVLNEALRLWPTAPAFSLYAKEDTVLGGEYPLEKGDEVMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 7 - protein, 1049 aa, Artificial Sequence
  Synthesized sequence
MTIKEMPQPKTFGELKNLPLLNTDKPVQALMKIADELGEIFKFEAPGCVTRYLSSQRLIKEACDESRFDKNLSQALKAVRDFAGDGLITSWTHEINWKKAHNILLPSFSQQAMKGYHAMMVDIAVQLVQKWERLNADEHIEVSEDMTRLTLDTIGLCGFNYRFNSFYRDQPHPFIISMVRALDEVMNKLQRANPDDPAYDENKRQCQEDIKVMNDLVDKIIADRKARGEQSDDLLTQMLNGKDPETGEPLDDGNISYQIITFLIAGHETTSGLLSFALYFLVKNPHVLQKVAEEAARVLVDPVPSYKQVKQLKYVGMVLNEALRLWPTAPAFSLYAKEDTVLGGEYPLEKGDEVMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 8 - protein, 1049 aa, Artificial Sequence
  Synthesized sequence
MTIKEMPQPKTFGELKNLPLLNTDKPVQALMKIADELGEIFKFEAPGCVTRYLSSQRLIKEACDESRFDKNLSQALKAVRDFAGDGLATSWTHEINWKKAHNILLPSFSQQAMKGYHAMMVDIAVQLVQKWERLNADEHIEVSEDMTRLTLDTIGLCGFNYRFNSFYRDQPHPFIISMVRALDEVMNKLQRANPDDPAYDENKRQCQEDIKVMNDLVDKIIADRKARGEQSDDLLTQMLNGKDPETGEPLDDGNISYQIITFLIAGHETTSGLLSFALYFLVKNPHVLQKVAEEAARVLVDPVPSYKQVKQLKYVGMVLNEALRLWPTAPAFSLYAKEDTVLGGEYPLEKGDEVMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 9 - protein, 1049 aa, Artificial Sequence
  Synthesized sequence
MTIKEMPQPKTFGELKNLPLLNTDKPVQALMKIADELGEIFKFEAPGCVTRYLSSQRLIKEACDESRFDKNLSQALKAVRDFLGDGLFTSWTHEINWKKAHNILLPSFSQQAMKGYHAMMVDIAVQLVQKWERLNADEHIEVSEDMTRLTLDTIGLCGFNYRFNSFYRDQPHPFIISMVRALDEVMNKLQRANPDDPAYDENKRQCQEDIKVMNDLVDKIIADRKARGEQSDDLLTQMLNGKDPETGEPLDDGNISYQIITFLIAGHETTSGLLSFALYFLVKNPHVLQKVAEEAARVLVDPVPSYKQVKQLKYVGMVLNEALRLWPTAPAFSLYAKEDTVLGGEYPLEKGDEVMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 10 - protein, 1049 aa, Artificial Sequence
  Synthesized sequence
MTIKEMPQPKTFGELKNLPLLNTDKPVQALMKIADELGEIFKFEAPGCVTRYLSSQRLIKEACDESRFDKNLSQALKAVRDFLGDGLFTSWTHEINWKKAHNILLPSFSQQAMKGYHAMMVDIAVQLVQKWERLNADEHIEVSEDMTRLTLDTIGLCGFNYRFNSFYRDQPHPFIISMVRALDEVMNKLQRANPDDPAYDENKRQCQEDIKVMNDLVDKIIADRKARGEQSDDLLTQMLNGKDPETGEPLDDGNISYQIITFLIAGHETTSGLLSFALYFLVKNPHVLQKVAEEAARVLVDPVPSYKQVKQLKYVGMVLNEALRLWPTVPAFSLYAKEDTVLGGEYPLEKGDEVMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 11 - protein, 1049 aa, Artificial Sequence
  Synthesized sequence
MTIKEMPQPKTFGELKNLPLLNTDKPVQALMKIADELGEIFKFEAPGRVTRYLSSQRLIKEACDESRFDKNLSQALKFARDFGGDGLVTSWTHEKNWKKAHNILLPSFSQQAMKGYHAMMVDIAVQLVQKWERLNADEHIEVSEDMTRLTLDTIGLCGFNYRFNSFYRDQPHPFIISMVRALDEVMNKLQRANPDDPAYDENKRQCQEDIKVMNDLVDKIIADRKARGEQSDDLLTQMLNGKDPETGEPLDDGNISYQIITFLIAGHETTSGLLSFALYFLVKNPHVLQKVAEEAARVLVDPVPSYKQVKQLKYVGMVLNEALRLWPTVPAFSLYAKEDTVLGGEYPLEKGDEVMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 12 - protein, 1049 aa, Artificial Sequence; identical to SEQ ID NO: 11
  Synthesized sequence

SEQ ID NO: 13 - protein, 1049 aa, Artificial Sequence
  Synthesized sequence
MTIKEMPQPKTFGELKNLPLLNTDKPVQALMKIADELGEIFKFEAPGCVTRYISSQRLIKEACDESRFDKNLSQALKFFRDFSGDGLFTSWTHEINWKKAHNILLPSFSQQAMKGYHAMMVDIAVQLVQKWERLNADEHIEVSEDMTRLTLDTIGLCGFNYRFNSFYRDQPHPFIISMVRALDEVMNKPQRANPDDPAYDENKRQCQEDIKVMNDLVDKIIADRKARGEQSDDLLTQMLNGKDPETGEPLDDGNISYQIITFLIAGHETTSGLLSFALYFLVKNPHVLQKVAEEAARVLVDPVPSYKQVKQLKYVGMVLNEALRLWPTFPAFSLYAKEDTVLGGEYPLEKGDEVMVLIPQLHRDKTVWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTGQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGTVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 14 - protein, 1049 aa, Artificial Sequence
  Synthesized sequence
MTIKEMPQPKTFGELKNLPLLNTDKPVQALMKIADELGEIFKFEAPGRVTRYLSSQRLIKEACDESRFDKNLSQALKFARDPLGDGLATSWTHEKNWKKAHNILLPSFSQQAMKGYHAMMVDIAVQLVQKWERLNADEHIEVSEDMTRLTLDTIGLCGFNYRFNSFYRDQPHPFIISMVRTLDEVMNKLQRANPDDPVYDENKRQCQEDIKVMNDLVDKIIADRKARGEQSDDLLTQMLNGKDPETGEPLDDGNISYQIITFLIAGHETTSGLLSFALYFLVKNPHVLQKVAEEAARVLVDPVPSYKQVKQLKYVGMVLNEALRLWPTAPAFSLYAKEDTVLGGEYPLEKGDEVMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 15 - protein, 1049 aa, Artificial Sequence
  Synthesized sequence
MTIKEMPQPKTFGELKNLPLLNTDKPVQALMKIADELGEIFKFEAPGRVTRYLSSQRLIKEACDESRFDKNLSQALKFARDSVGDGLATSWTHEKNWKKAHNILLPSFSQQAMKGYHAMMVDIAVQLVQKWERLNADEHIEVSEDMTRLTLDTIGLCGFNYRFNSFYRDQPHPFIISMVRTLDEVMNKLQRANPDDPVYDENKRQCQEDIKVMNDLVDKIIADRKARGEQSDDLLTQMLNGKDPETGEPLDDGNISYQIITFLIAGHETTSGLLSFALYFLVKNPHVLQKVAEEAARVLVDPVPSYKQVKQLKYVGMVLNEALRLWPTAPAFSLYAKEDTVLGGEYPLEKGDEVMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 16 - protein, 1048 aa, Artificial Sequence
  Synthesized sequence
TIKEMPQPKTFGELKNLPLLNTDKPVQALMKIADELGEIFKFEAPGRVTRYLSSQRLIKEACDESRFDKNLSQALKFVRDFAGDGLVTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKQQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 17 - protein, 1048 aa, Artificial Sequence
  Synthesized sequence
TIKEMPQPKTFGELKNLPLLNTDKPVQALMKIADELGEIFKFEAPGRVTRYLSSQRLIKEACDESRFDKNLSQGLKFVRDFAGDGLVTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKQQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 18 - protein, 983 aa, Artificial Sequence
  Synthesized sequence
TIKEMPQPKTFGELKNLPLLNTDKPVQALMKIADELGEIFKFEAPGLVTRYLSSQRLIKEACDESRFDKNLSQALKFVRDFAGDGLVTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKQQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDG

SEQ ID NO: 19 - protein, 1060 aa, Bacillus subtilis
MKETSPIPQPKTFGPLGNLPLIDKDKPTLSLIKLAEEQGPIFQIHTPAGTTIVVSGHELVKEVCDEERFDKSIEGALEKVRAFSGDGLFTSWTHEPNWRKAHNILMPTFSQRAMKDYHEKMVDIAVQLIQKWARLNPNEAVDVPGDMTRLTLDTIGLCGFNYRFNSYYRETPHPFINSMVRALDEAMHQMQRLDVQDKLMVRTKRQFRYDIQTMFSLVDSIIAERRANGDQDEKDLLARMLNVEDPETGEKLDDENIRFQIITFLIAGHETTSGLLSFATYFLLKHPDKLKKAYEEVDRVLTDAAPTYKQVLELTYIRMILNESLRLWPTAPAFSLYPKEDTVIGGKFPITTNDRISVLIPQLHRDRDAWGKDAEEFRPERFEHQDQVPHHAYKPFGNGQRACIGMQFALHEATLVLGMILKYFTLIDHENYELDIKQTLTLKPGDFHISVQSRHQEAIHADVQAAEKAAPDEQKEKTEAKGASVIGLNNRPLLVLYGSDTGTAEGVARELADTASLHGVRTKTAPLNDRIGKLPKEGAVVIVTSSYNGKPPSNAGQFVQWLQEIKPGELEGVHYAVFGCGDHNWASTYQYVPRFIDEQLAEKGATRFSARGEGDVSGDFEGQLDEWKKSMWADAIKAFGLELNENADKERSTLSLQFVRGLGESPLARSYEASHASIAENRELQSADSDRSTRHIEIALPPDVEYQEGDHLGVLPKNSQTNVSRILHRFGLKGTDQVTLSASGRSAGHLPLGRPVSLHDLLSYSVEVQEAATRAQIRELASFTVCPPHRRELEELSAEGVYQEQILKKRISMLDLLEKYEACDMPFERFLELLRPLKPRYYSISSSPRVNPRQASITVGVVRGPAWSGRGEYRGVASNDLAERQAGDDVVMFIRTPESRFQLPKDPETPIIMVGPGTGVAPFRGFLQARDVLKREGKTLGEAHLYFGCRNDRDFIYRDELERFEKDGIVTVHTAFSRKEGMPKTYVQHLMADQADTLISILDRGGRLYVCGDGSKMAPDVEAALQKAYQAVHGTGEQEAQNWLRHLQDTGMYAKDVWAG

SEQ ID NO: 20 - protein, 1060 aa, Artificial Sequence
  Synthesized sequence
MKETSPIPQPKTFGPLGNLPLIDKDKPTLSLIKLAEEQGPIFQIHTPAGTTIVVSGHELVKEVCDEERFDKSIEGALEKVRAFSGDGLATSWTHEPNWRKAHNILMPTFSQRAMKDYHEKMVDIAVQLIQKWARLNPNEAVDVPGDMTRLTLDTIGLCGFNYRFNSYYRETPHPFINSMVRALDEAMHQMQRLDVQDKLMVRTKRQFRYDIQTMFSLVDSIIAERRANGDQDEKDLLARMLNVEDPETGEKLDDENIRFQIITFLIAGHETTSGLLSFATYFLLKHPDKLKKAYEEVDRVLTDAAPTYKQVLELTYIRMILNESLRLWPTAPAFSLYPKEDTVIGGKFPITTNDRISVLIPQLHRDRDAWGKDAEEFRPERFEHQDQVPHHAYKPFGNGQRACIGMQFALHEATLVLGMILKYFTLIDHENYELDIKQTLTLKPGDFHISVQSRHQEAIHADVQAAEKAAPDEQKEKTEAKGASVIGLNNRPLLVLYGSDTGTAEGVARELADTASLHGVRTKTAPLNDRIGKLPKEGAVVIVTSSYNGKPPSNAGQFVQWLQEIKPGELEGVHYAVFGCGDHNWASTYQYVPRFIDEQLAEKGATRFSARGEGDVSGDFEGQLDEWKKSMWADAIKAFGLELNENADKERSTLSLQFVRGLGESPLARSYEASHASIAENRELQSADSDRSTRHIEIALPPDVEYQEGDHLGVLPKNSQTNVSRILHRFGLKGTDQVTLSASGRSAGHLPLGRPVSLHDLLSYSVEVQEAATRAQIRELASFTVCPPHRRELEELSAEGVYQEQILKKRISMLDLLEKYEACDMPFERFLELLRPLKPRYYSISSSPRVNPRQASITVGVVRGPAWSGRGEYRGVASNDLAERQAGDDVVMFIRTPESRFQLPKDPETPIIMVGPGTGVAPFRGFLQARDVLKREGKTLGEAHLYFGCRNDRDFIYRDELERFEKDGIVTVHTAFSRKEGMPKTYVQHLMADQADTLISILDRGGRLYVCGDGSKMAPDVEAALQKAYQAVHGTGEQEAQNWLRHLQDTGMYAKDVWAG

SEQ ID NO: 21 - protein, 1053 aa, Bacillus subtilis
MKQASAIPQPKTYGPLKNLPHLEKEQLSQSLWRIADELGPIFRFDFPGVSSVFVSGHNLVAEVCDEKRFDKNLGKGLQKVREFGGDGLFTSWTHEPNWQKAHRILLPSFSQKAMKGYHSMMLDIATQLIQKWSRLNPNEEIDVADDMTRLTLDTIGLCGFNYRFNSFYRDSQHPFITSMLRALKEAMNQSKRLGLQDKMMVKTKLQFQKDIEVMNSLVDRMIAERKANPDENIKDLLSLMLYAKDPVTGETLDDENIRYQIITFLIAGHETTSGLLSFAIYCLLTHPEKLKKAQEEADRVLTDDTPEYKQIQQLKYIRMVLNETLRLYPTAPAFSLYAKEDTVLGGEYPISKGQPVTVLIPKLHRDQNAWGPDAEDFRPERFEDPSSIPHHAYKPFGNGQRACIGMQFALQEATMVLGLVLKHFELINHTGYELKIKEALTIKPDDFKITVKPRKTAAINVQRKEQADIKAETKPKETKPKHGTPLLVLFGSNLGTAEGIAGELAAQGRQMGFTAETAPLDDYIGKLPEEGAVVIVTASYNGAPPDNAAGFVEWLKELEEGQLKGVSYAVFGCGNRSWASTYQRIPRLIDDMMKAKGASRLTAIGEGDAADDFESHRESWENRFWKETMDAFDINEIAQKEDRPSLSITFLSEATETPVAKAYGAFEGIVLENRELQTAASTRSTRHIELEIPAGKTYKEGDHIGILPKNSRELVQRVLSRFGLQSNHVIKVSGSAHMAHLPMDRPIKVVDLLSSYVELQEPASRLQLRELASYTVCPPHQKELEQLVSDDGIYKEQVLAKRLTMLDFLEDYPACEMPFERFLALLPSLKPRYYSISSSPKVHANIVSMTVGVVKASAWSGRGEYRGVASNYLAELNTGDAAACFIRTPQSGFQMPNDPETPMIMVGPGTGIAPFRGFIQARSVLKKEGSTLGEALLYFGCRRPDHDDLYREELDQAEQDGLVTIRRCYSRVENEPKGYVQHLLKQDTQKLMTLIEKGAHIYVCGDGSQMAPDVERTLRLAYEAEKAASQEESAVWLQKLQDQRRYVKDVWTG

SEQ ID NO: 22 - protein, 1053 aa, Artificial Sequence
  Synthesized sequence
MKQASAIPQPKTYGPLKNLPHLEKEQLSQSLWRIADELGPIFRFDFPGVSSVFVSGHNLVAEVCDEKRFDKNLGKGLQKVREFGGDGLATSWTHEPNWQKAHRILLPSFSQKAMKGYHSMMLDIATQLIQKWSRLNPNEEIDVADDMTRLTLDTIGLCGFNYRFNSFYRDSQHPFITSMLRALKEAMNQSKRLGLQDKMMVKTKLQFQKDIEVMNSLVDRMIAERKANPDENIKDLLSLMLYAKDPVTGETLDDENIRYQIITFLIAGHETTSGLLSFAIYCLLTHPEKLKKAQEEADRVLTDDTPEYKQIQQLKYIRMVLNETLRLYPTAPAFSLYAKEDTVLGGEYPISKGQPVTVLIPKLHRDQNAWGPDAEDFRPERFEDPSSIPHHAYKPFGNGQRACIGMQFALQEATMVLGLVLKHFELINHTGYELKIKEALTIKPDDFKITVKPRKTAAINVQRKEQADIKAETKPKETKPKHGTPLLVLFGSNLGTAEGIAGELAAQGRQMGFTAETAPLDDYIGKLPEEGAVVIVTASYNGAPPDNAAGFVEWLKELEEGQLKGVSYAVFGCGNRSWASTYQRIPRLIDDMMKAKGASRLTAIGEGDAADDFESHRESWENRFWKETMDAFDINEIAQKEDRPSLSITFLSEATETPVAKAYGAFEGIVLENRELQTAASTRSTRHIELEIPAGKTYKEGDHIGILPKNSRELVQRVLSRFGLQSNHVIKVSGSAHMAHLPMDRPIKVVDLLSSYVELQEPASRLQLRELASYTVCPPHQKELEQLVSDDGIYKEQVLAKRLTMLDFLEDYPACEMPFERFLALLPSLKPRYYSISSSPKVHANIVSMTVGVVKASAWSGRGEYRGVASNYLAELNTGDAAACFIRTPQSGFQMPNDPETPMIMVGPGTGIAPFRGFIQARSVLKKEGSTLGEALLYFGCRRPDHDDLYREELDQAEQDGLVTIRRCYSRVENEPKGYVQHLLKQDTQKLMTLIEKGAHIYVCGDGSQMAPDVERTLRLAYEAEKAASQEESAVWLQKLQDQRRYVKDVWTG

SEQ ID NO: 23 - protein, 1065 aa, Bacillus anthracis
MDKKVSAIPQPKTYGPLGNLPLIDKDKPTLSFIKLAEEYGPIFRMQTLSDTIIVVSGHELVAEVCDETRFDKSIEGALAKVRAFAGDGLFTSETQEPNWQKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSENQEENDLLSRMLNVQDPETGEKLDDENIRFQIITFLIAGHETTSGLLSFAIYFLLKNPDKLKKAYEEVDRVLTDSTPTYQQVMKLKYIRMILNESLRLWPTAPAFSLYAKEDTVIGGKYPIKKGEDRISVLIPQLHRDKDAWGDNVEEFQPERFEELDKVPHHAYKPFGNGQRACIGMQFALHEATLVMGMLLQHFEFIDYEEYQLDVKQTLTLKPGDFKIRIVPRNQTISHTTVLAPTEEKLKNHEIKQQVQKTPSIIGADNLSLLVLYGSDTGVAEGIARELADTASLEGVQTEVAALNDRIGSLPKEGAVLIVTSSYNGKPPSNAGQFVQWLEELKGDELKGVQYAVFGCGDHNWASTYQRIPRYIDEQMAQKGATRFSTRGEADASGDFEEQLEQWKQRMWSDAMKVFGLELNKNMEKERSTLSLQFVSRLGGSPLARTYEAVYASILENRELQSSSSERSTRHIEISLPEGATYKEGDHLGVLPINSEKNVNRILKRFGLNGKDQVILSASGRSVNHIPLDSPVRLYDLLSYSVEVQEAATRAQIREMVTFTACPPHKKELESLLEDGVYQEQILKKRISMLDLLEKYEACEIRFEPFLELLPALKPRYYSISSSPLVAQDRLSITVGVVNAPAWSGEGTYEGVASNYLAQRHNKDEIICFIRTPQSNFQLPENPETPIIMVGPGTGIAPFRGFLQARRVQKQKGMNVGEAHLYFGCRHPEKDYLYRTELENDERDGLISLHTAFSRLEGQAKTYVQHVIKEDRIHLISLLDNGAHLYICGDGSKMAPDVEDTLCQAYQEIHEVSEQEARNWLDRLQEEGRYGKDVWAGI

SEQ ID NO: 24 - protein, 1065 aa, Bacillus cereus
MDKKVSAIPQPKTYGPLGNLPLIDKDKPTLSFIKIAEEYGPIFQIQTLSDTIIVISGHELVAEVCDETRFDKSIEGALAKVRAFAGDGLFTSETQEPNWKKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSGNQEENDLLSRMLHVQDPETGEKLDDENIRFQIITFLIAGHETTSGLLSFAIYFLLKNPDKLKKAYEEVDRVLTDPTPTYQQVMKLKYIRMILNESLRLWPTAPAFSLYAKEDTVIGGKYPIKKGEDRISVLIPQLHRDKDAWGDNVEEFQPERFEDLDKVPHHAYKPFGNGQRACIGMQFALHEATLVMGMLLQHFEFIDYEDYQLDVKQTLTLKPGDFKIRIVPRNQNISHTTVLAPTEEKLKNHEIKQQVQKTPSIIGADNLSLLVLYGSDTGVAEGIARELADTASLEGVQTEVAALNDRIGSLPKEGAVLIVTSSYNGKPPSNAGQFVQWLEELKPDELKGVQYAVFGCGDHNWASTYQRIPRYIDEQMAQKGATRFSTRGEADASGDFEEQLEQWKESMWSDAMKAFGLELNKNMEKERSTLSLQFVSRLGGSPLARTYEAVYASILENRELQSSSSERSTRHIEISLPEGATYKEGDHLGVLPINSEKNVNRILKRFGLNGKDQVILSASGRSVNHIPLDSPVRLYDLLSYSVEVQEAATRAQIREMVTFTACPPHKKELESLLEDGVYHEQILKKRISMLDLLEKYEACEIRFERFLELLPALKPRYYSISSSPLIAQDRLSITVGVVNAPAWSGEGTYEGVASNYLAQRHNKDEIICFIRTPQSNFQLPENPETPIIMVGPGTGIAPFRGFLQARRVQKQKGMNLGEAHLYFGCRHPEKDYLYRTELENDERDGLISLHTAFSRLEGHPKTYVQHVIKEDRMNLISLLDNGAHLYICGDGSKMAPDVEDTLCQAYQEIHEVSEQEARNWLDRLQDEGRYGKDVWAGI

SEQ ID NO: 25 - protein, 1078 aa, Bacillus cereus
MSSKNRLDPIPQPPTKPVVGNMLSLDSAAPVQHLTRLAKELGPIFWLDMMGSPIVVVSGHDLVDELSDEKRFDKTVRGALRRVRAVGGDGLFTADTREPNWSKAHNILLQPFGNRAMQSYHPSMVDIAEQLVQKWERLNADDEIDVVHDMTALTLDTIGLCGFDYRFNSFYRRDYHPFVESLVRSLETIMMTRGLPFEQIWMQKRRKTLAEDVAFMNKMVDEIIAERRKSAEGIDDKKDMLAAMMTGVDRSTGEQLDDVNIRYQINTFLIAGHETTSGLLSYTLYALLKHPDILKKAYDEVDRVFGPDVNAKPTYQQVTQLTYITQILKEALRLWPPAPAYGISPLADETIGGGKYKLRKGTFITILVTALHRDPSVWGPNPDAFDPENFSREAEAKRPINAWKPFGNGQRACIGRGFAMHEAALALGMILQRFKLIDHQRYQMHLKETLTMKPEGFKIKVRPRADRERGAYGGPVAAVSSAPRAPRQPTARPGHNTPMLVLYGSNLGTAEELATRMADLAEINGFAVHLGALDEYVGKLPQEGGVLIICASYNGAPPDNATQFVKWLGSDLPKDAFANVRYAVFGCGNSDWAATYQSVPRFIDEQLSGHGARAVYPRGEGDARSDLDGQFQKWFPAAAQVATKEFGIDWNFTRTAEDDPLYAIEPVAVTAVNTIVAQGGAVAMKVLVNDELQNKSGSNPSERSTRHIEVQLPSNITYRVGDHLSVVPRNDPTLVDSVARRFGFLPADQIRLQVAEGRRAQLPVGEAVSVGRLLSEFVELQQVATRKQIQIMAEHTRCPVTKPKLLAFVGEEAEPAERYRTEILAMRKSVYDLLLEYPACELPFHVYLEMLSLLAPRYYSISSSPSVDPARCSITVGVVEGPAASGRGVYKGICSNYLANRRASDAIYATVRETKAGFRLPDDSSVPIIMIGPGTGLAPFRGFLQERAARKAKGASLGPAMLFFGCRHPDQDFLYADELKALAASGVTELFTAFSRADGPKTYVQHVLAAQKDKVWPLIEQGAIIYVCGDGGQMEPDVKAALVAIRHEKSGSDTATAARWIEEMGATNRYVLDVWAGG

SEQ ID NO: 26 - protein, 1074 aa, Bacillus licheniformis
MNKLDGIPIPKTYGPLGNLPLLDKNRVSQSLWKIADEMGPIFQFKFADAIGVFVSSHELVKEVSEESRFDKNMGKGLLKVREFSGDGLFTSWTEEPNWRKAHNILLPSFSQKAMKGYHPMMQDIAVQLIQKWSRLNQDESIDVPDDMTRLTLDTIGLCGFNYRFNSFYREGQHPFIESMVRGLSEAMRQTKRFPLQDKLMIQTKRRFNSDVESMFSLVDRIIADRKQAESESGNDLLSLMLHAKDPETGEKLDDENIRYQIITFLIAGHETTSGLLSFAIYLLLKHPDKLKKAYEEADRVLTDPVPSYKQVQQLKYIRMILNESIRLWPTAPAFSLYAKEETVIGGKYLIPKGQSVTVLIPKLHRDQSVWGEDAEAFRPERFEQMDSIPAHAYKPFGNGQRACIGMQFALHEATLVLGMILQYFDLEDHANYQLKIKESLTLKPDGFTIRVRPRKKEAMTAMPGAQPEENGRQEERPSAPAAENTHGTPLLVLYGSNLGTAEEIAKELAEEAREQGFHSRTAELDQYAGAIPAEGAVIIVTASYNGNPPDCAKEFVNWLEHDQTDDLRGVKYAVFGCGNRSWASTYQRIPRLIDSVLEKKGAQRLHKLGEGDAGDDFEGQFESWKYDLWPLLRTEFSLAEPEPNQTETDRQALSVEFVNAPAASPLAKAYQVFTAKISANRELQCEKSGRSTRHIEISLPEGAAYQEGDHLGVLPQNSEVLIGRVFQRFGLNGNEQILISGRNQASHLPLERPVHVKDLFQHCVELQEPATRAQIRELAAHTVCPPHQRELEDLLKDDVYKDQVLNKRLTMLDLLEQYPACELPFARFLALLPPLKPRYYSISSSPQLNPRQTSITVSVVSGPALSGRGHYKGVASNYLAGLEPGDAISCFIREPQSGFRLPEDPETPVIMVGPGTGIAPYRGFLQARRIQRDAGVKLGEAHLYFGCRRPNEDFLYRDELEQAEKDGIVHLHTAFSRLEGRPKTYVQDLLREDAALLIHLLNEGGRLYVCGDGSRMAPAVEQALCEAYRIVQGASREESQSWLSALLEEGRYAKDVWDGGVSQHNVKADCIART

SEQ ID NO: 27 - protein, 1065 aa, Bacillus thuringiensis
MDKKVSAIPQPKTYGPLGNLPLIDKDKPTLSFIKLAEEYGPIFQIQTLSDTIIVVSGHELVAEVCDETRFDKSIEGALAKVRAFAGDGLFTSETDEPNWKKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSENQEENDLLSRMLNVQDPETGEKLDDENIRFQIITFLIAGHETTSGLLSFAIYFLLKNPDKLKKAYEEVDRVLTDSTPTYQQVMKLKYIRMILNESLRLWPTAPAFSLYAKEDTVIGGKYPIKKGEDRISVLIPQLHRDKDAWGDDVEEFQPERFEELDKVPHHAYKPFGNGQRACIGMQFALHEATLVMGMLLQHFEFIDYEDYQLDVKQTLTLKPGDFKIRIVPRNQTISHTTVLAPTEEKLKKHEIKKQVQKTPSIIGADNLSLLVLYGSDTGVAEGIARELADTASLEGVQTEVVALNDRIGSLPKEGAVLIVTSSYNGKPPSNAGQFVQWLEELKPDELKGVQYAVFGCGDHNWASTYQRIPRYIDEQMAQKGATRFSTRGEADASGDFEEQLEQWKQSMWSDAMKAFGLELNKNMEKERSTLSLQFVSRLGGSPLARTYEAVYASILENRELQSSSSERSTRHIEISLPEGATYKEGDHLGVLPINNEKNVNRILKRFGLNGKDQVILSASGRSVNHIPLDSPVRLYDLLSYSVEVQEAATRAQIREMVTFTACPPHKKELESLLEDGVYQEQILKKRISMLDLLEKYEACEIRFERFLELLPALKPRYYSISSSPLVAQDRLSITVGVVNAPAWSGEGTYEGVASNYLAQRHNKDEIICFIRTPQSNFQLPENPETPIIMVGPGTGIAPFRGFLQARRVQKQKGMKVGEAHLYFGCRHPEKDYLYRTELENDERDGLISLHTAFSRLEGHPKTYVQHVIKEDRIHLISLLDNGAHLYICGDGSKMAPDVEDTLCQAYQEIHEVSEQEARNWLDRLQEEGRYGKDVWAGI

SEQ ID NO: 28 - protein, 1065 aa, Bacillus weihenstephanensis
MDKKVSAIPQPKTYGLLGNLPLIDKDKPTLSFIKIAEEYGPIFRIQTLSDTIIVVSGHELVAEVCDETRFDKSIEGALAKVRAFAGDGLFTSETHEPNWKKAHNILMPTFSQRAMKDYHAMMVDIAVQLVQKWARLNPNENVDVPEDMTRLTLDTIGLCGFNYRFNSYYRETPHPFITSMSRALDEAMHQLQRLDIEDKLMWRTKRQFQHDIQSMFSLVDNIIAERKSSGNQEENDLLSRMLNVQDPETGEKLDDENIRFQIITFLIAGHETTSGLLSFAIYFLLKNPDKLKKAYEEVDRVLTDPTPTYQQVMKLKYIRMILNESLRLWPTAPAFSLYAKEDTVIGGKYPIKKGEDRISVLIPQLHRDKDAWGDNVEEFQPERFEELDKIPHHAYKPFGNGQRACIGMQFALHEATLVMGMLLQHFEFIDYQDYQLDVKQTLTLKPGDFKIRILPRNQTISHTTVLAPIEEKLKNDEIEQQVQKTPSIIGADNLSLLVLYGSDTGVAEGIARELADTASLEGVQTEVVALNDRIGSLPKEGAVLIVTSSYNGKPPSNAGQFVQWLEELKSDELKGVQYAVFGCGDHNWASTYQRIPRYIDEQMAQKGATRFSTRGEADASGDFEEQLEQWKQSMWSDAMKAFGLELNKNIEKERSTLSLQFVSRLGGSPLARTYEAVYASILENRELQSSSSERSTRHIEISLPEGATYQEGDHLGVLPINSEKNVNRILKRFGLNGKDQVILSASGRSVNHIPLDSPVSLFDLLSYSVEVQEAATRAQIREMVTFTACPPHKKELELLLEEGVYHEQILKKRMSMLDLLEKYEACEIRFERFLELLPALKPRYYSISSSPLVAQDRLSITVGVVNAPAWSGEGTYEGVASNYLAQRHNKDEIICFIRTPQSNFQLPENPETPIIMVGPGTGVAPFRGFLQARRVQKQKGINLGQAHLYFGCRHPEKDYLYRTELENDERDGLISLHIAFSRLEGYPKTYVQHLIKQDRINLISLLDNGAHLYICGDGSKMAPDVEDTLCQAYQEIHEVSEQEARNWLDRVQEEGRYGKDVWAGI

SEQ ID NO: 29 - protein, 1070 aa, Erythrobacter litoralis
MDAPTALAPIPQPPGKPIVGNAFTVDSSRLIQSLMELAEEYGPIFQLEVMGTPLVFVSGADMVAEICDESRFDKTVRGPLKRLRLIAGDGLFTGDTDDPNWAKAHHILLPSFSQKAMGSYLPMMTDIASQLMLKWERLNSDDVIDVPMDMVRLTLDTIGVCGFGYRFNSFYREDFHPFIEALNRTLDTTQKMRGLPGEKLLKRQQIEQLNEDAAYMNNLVDEIIRERRQTGESGQGDLLDFMLSGRDPVTGERLSDENIRYQINTFLIAGHETTSGLLSFTLYYLLKNRDVLQRAYAEVDEVLGRNIDQTPTLSQIGRLPYIRAILSEALRLWPTAPAMGLAPFEDEVLGGKYAIAKGTFTTVLIPSLHRDKLVWGENPEAFNPDNFSPKAEAARPPHAYKPFGNGQRACIGRQFAIQESILVLGMLLQRFELFDHADYQLRIKETLSIKPDGFTIKARLRHDVERGGVATVEPESKTPDQAAAVPSHGTPLLVLYGSNLGSSEGFARELAQRGEFSGFDVTMAPLDAHVAKLPTDGAVAIACASYNGMPPDNAAKFVDWLEQADAADAPLSNVSYLVLGCGNSDWAATFQVVPRKIDALMEQHGAERLVPAEELDARGDLDTQFHDWLDGLIPQLGDAFDIDLESGFDAVFEPLYTVEITDSITGNTVADRVGAREVEVVANRELKDTSKDEGRSTRHLEVRLPEGMEYEPGDHLCVVPVNDPAVVDRLLKRFGLDRDTFVRIESRSDMRGPFPSGSTFSVLNLAETAGELQAVATRKDIATLARYSECPNSRAALEALAAPPSADGTDRYTSEVLEKRRSVLDMLEEFPACDVPLAVFLELIPFLSPRYYSISSAPEANQGLCSITVGVVKGPALAGTGEFKGTCSAYLADLPPGDRFRAVVRKPTAQFRLPDNPETPVIMIGPGTGVAPFRAFLQRRDHLQEDGAVLGEAMLFFGCRHPDIDYLYREELDDYDQRGVATVHAAFSRHDGSRTYVQDLIAREADRVWELIEQDARIYVCGDGARMEPDVRKALMAIYAEKKSSDEASAKAWIDDLVAQDRYLLDVWVG

SEQ ID NO: 30 - protein, 1071 aa, Erythrobacter sp.
MATNATLTPIPQPPGKPLIGNALTVDASQQIQSLMELAEEYGPIFQLDMMGTPIVIISGADLVAEVCDEKRFDKSVRGPLKRLRLIGGDGLFTGDTDAPNWSKAHNILLPSFSQKAMGSYLPMMTDIATQLVMKWERMNSDDVIDVPKDMIRLTLDTIGVCGFGYRFNSFYREDFHPFIRALTRTLETTQKIRGIPGEKLLKGDAVKQLHRDAKYMNNLVDEIIRERQRSGGDGPEDLLDFMLSGRDPLTGERLSDENIRYQINTFLIAGHETTSGLLSFTLYYLLKNRDVLTRAYAEVDTVLGRNIDQPPSLKQIGQLPYIRAILFEALRLWPTAPAFGLAPFEDEVLGGKYLIPKGTFTTVLIPSLHRDKSVWGENPEVFDPENFTAEAEAARPPHAYKPFGNGQRACIGRQFAIQESILVLAMILQRFELFDHSDYKLDIKETLSIKPDEFTIKARMRKDVERGGKATEDAEEASTEPAEPKVPKHDTPLLVLYGSNLGSSESFAREVAQKGEFSGFEVEMAPLDDYVGKLPEDGAVAIACASYNGMPPDNAAKFIDWIEGKDGAAPDLSGVSYMMLGCGNSDWAATFQAVPRLIDARMEELGAKRIVPTTELDARSDVDTQFHTWLDALMPQLGEHFDLDLSGEAAGIAEPLYKVEVTQSVTANTVASRVGAHAVKMVANRELKNTDIGEGRSTRHIEVELAQGETYQPGDHLCVVPENDDAVVERLLRRFNLDADTYVRIESRSEMRGPFPSGSTFSVYNLAKTAGELQAVATRKDIATLALYTECPNSKPALEKLAQPPQEDGTDQYATDVLAKRKSVLDLLEDYPACDLPLAVFLEMIPFLSPRYYSISSAPGDTPQTCSITVGVVKGPALSGKGTFKGTCSNYLAELEPGASFNAVVREPTANFRLPDDPKVPLIMVGPGTGLAPFRGFLQERDALASSGEELGPARLYFGCRTPDEDFLYRDELEDYDKRGIVTLRTAFSRVDEGKCYVQDHIADDADAIWEMLEAGGRIYVCGDGARMEPDVRAALAKIHSDKTGSTPAEAQSWVGDLITNERYSLDVWVG

SEQ ID NO: 31 - protein, 1072 aa, Rhodopseudomonas palustris
MSSSNKLAPIPHPPKQPVVGNMLSIDTKAPVQHLVRLAEELGPIFWLDMMGAPIVIVSGYDLVDEISDEKRFDKAVRGALRRVRTVGGDGLFTADTSEPNWSKAHNILLTPFGGRAMQSYHPSMVDIAEQLVKKWERLNADDEIDVVHDMTALTLDTIGLCGFDYRFNSFYRRDYHPFVESLVRSLETIMMTRGLPLENLWMKKRRDTLAEDVAFMNAMVDEIIAERRKAAAVADKMDMLGAMMTGVDKVTGEPLDDVNIRYQINTFLIAGHETTSGLLSCAIYALLKHPEVLQKAYDEVDRVLGADTSVEPSYQQVNQLGYITQILKETLRLWPPAPAYGVAPIQDETIGGQYHLKRGTFTTVLVLALHRDPSIWGPNPDAFDPENFSREAESKRPANAWKPFGNGQRACIGRGFAMHEAALALGMILQRFKLIDHTRYRMVLKETLTIKPEGFKIKVRPRSDKDRATRIASGVSHSVAPAPAAPRARPGHNTPLLVLYGSNLGTAEELAHRVADLADLNGFATRLGALDQYVGQLPEEGGVLIFAASYNGAPPDNATQFVRWLSGDLPPDAFAKLRYAVFGCGNRDWTATYQAIPRLIDERLAAHGGRNIFVRGEGDARDDLEGQFEAWFATLGPLAVKEFGIDAAFDRGADDTPLYGIEPLAPAASQPLAATGVAVAMRVLENRELQDRAASGRSTRHIEIALPQGMSYRVGDHLSVIPRNDPALVAAVAQRFGFAPDDQIRLSAAPGRRAQLPVGEAVSIGGLLGDHVELQQVATRKQIVALAAHTRCPQTRPKLQALAGGDGAADDAYRAEVLGKRRSVFDLLQEHPACELPFAAYLEMLTPLQPRYYSISSSPARDPARASVTVAVVEGPALSGRGIYRGACSSWLAGRGSGDTVQATVRATKACFRLPDDDRVPLIMIGPGTGVAPFRGFLQERSARKVGGATLGPALLFFGCRHPAQDYLYADELQGFAADGIVELHAAFSRGDGPKTYVQHLIAAQKDRVFALIEQGAIVYVCGDGGRMEPDVKAALCAIHRERSGADATAAAAWIADLGARDRYVLDVWASV

SEQ ID NO: 32 - protein, 1075 aa, Rhodopseudomonas palustris
MPSTNKLDPIPHPPKKPVVGNMLSLDTTAPVQHLVRLAKELGPIFWLDMMGAPLVIVSGYDLVDEISDEKRFDKAVRGALRRARAVGGDGLFTADTKEPNWSKAHNILLTPFGGRAMQSYHPSMVDIAEQLVKKWERLNADDEIDVVHDMTALTLDTIGLCGFDYRFNSFYRRDYHPFVESLVRSLETIMMTRGLPLENLWMKKRRETLADDVVFMNAMVDEIIAERRKASESAADKKDMLGAMLAGVDRATGEPLDDVNIRYQINTFLIAGHETTSGLLSCAIYALLKHPDVLQKAYDEVDRVLGSDTAVRPSYQQVNQLSYITQILKETLRMWPPAPAYGVAPIKDEVIGGKYHLKRGTFVTVLVLALHRDPAIWGPNPDAFDPENFSREAESKRPANAWKPFGNGQRACIGRGFAMHEAALALGMILQRFQLIDHQRYRMVLKETLTIKPEGFKIKVRPRSDKDRGDFVAAGASQVSTPALAQAAPRARPDHNTPLLVLYGSNLGTAEELATRVADLAELNGFSTRLGALDQYVGHLPEEGGVLIFTASYNGAPPDNATQFVQWLSGDLPKDAFAKLRYAVFGCGNRDWTATYQAIPRLVDERLAAHGGRNIFLRGEGDARDDLEGQFESWFAKLGPLAVKEFGIDAKFARAVDDAPLYRIEPVAPAAGNAVAAAGGAVPMKVLANRELQDCAASGRSTRHIEIALPEGISYRVGDHLSVMPRNDPALVAAVAQRLGFAPDDQIKLQVAPGRRAQLPIGEAISVGRLLGDFVELQQVATRKQIAVMAEHTRCPQTRPKLQALAGGDGAADEAYRAGVLAKRKSVYDLMQEHPACELPLHAYLEMLSPLAPRYYSISSSPLRDPSRAAITVAVVDGPALSGRGHYRGVCSTWLAGRSVGDTIHATVRATKAGFRLPDDDRVPLIMIGPGTGLAPFRGFLQERAARQQNGATLGPALLFFGCRHPAQDYLYADELQGFAAEGVVELHTAFSRGEGPKTYVQHLIAAQKDRVFTLIEQGAIIYVCGDGGKMEPDVRAALMAIHRERSGADAAAASTWIDDLGACNRYVLDVWASA

SEQ ID NO: 33 - protein, 1079 aa, uncultured soil bacterium
MASNNKMSPIPQPPTRPVVGNMLSLDSAAPVQDLTRLAKELGPIFWLDMMGAPIVIVSGYTLVDELSVETRLDKVVRGALRRVRAIGGDGLFTADTAEPNWSKARNILLQPFGNRAMQSYHPSMVDIAEQLVKKWERLNADDEIDVVHDMTALTLDTIGLCGFDYRFNSFYRRDYHPFVESLVRSLETIMMIRGLPLENFWMRRRRSDLATDVAFMNKMVDEIVAERRKSAEASDGKKDMLNAMMSGVDRSTGEQLDDVNIRYQINTFLIAGHETTSGLLSYAIYALLKHPDVLKKAYAEVDRVLGADIEARPSYQQVTQLTYITQILKEALRLWPPAPAYGIAPLKDETIAGGKYSLKKNTFISILVTALHHDPAVWGPNPDLFDPENFSPEAEAKRPVNAWRPFGNGQRACIGRGFAMHEAALALGMILQRFKLIDHQRYQIRLKETLTIKPDGFKIKVRPRSGHDRTVHAEAATAAVATGAALPRARPRPGHNTPLLVLYGSNLGTAEDLATRVADLAEVNGFATRLAPLDDCAGQLPDSGGVLIFCASYNGAPPDNATKFVGWLRGELPNDAFAKLRYAVFGCGNRDWAATYQSVPRLIDETLSAHGGKRVFPRGEGDARSDLDGQFESWFAALGAAAVKEFGLESRFSRSADDAPLYSVEPVAPSAVNAVAALGGTVPMTILVSRELQNKSGPDASERSTRHIEVQLPGGMTYRVGDHLSVVPCNAPALVDRVARRFGFLPADQIRLAVAEGRRAQLPVGEAVSIGQLLTDFVELQQVATRKQIQIMSEHTRCPVTKPKLVAYVGDDADSSERYRADILSRRKSVYDLLEEFPAIELPFPAYLEMLSLLAPRYYSISSSPTGDASRCSITVGVVSCPASSTGRGLYRGVCPYYLASRREGESVFATVRETKAGFRLPDDPSVPIIMIGPGTGLAPFRGFLQERAARKAGGATLGPAMLFFGCRHPEQDYLYADELKAFADEGITELFVAFSRSEGPKTYVQHLLATQKARVWDLIEQGAVIFVCGDGSKMEPDVKATLVQIYRDCTGADANGGAKWIADLGAQNRYVLDVWAGG

SEQ ID NO: 34 - protein, 1047 aa, Bacillus pumilus
MQQTSIIPKPKTYGPFKNIPHIKKGELSQTFWRLADELGPIFQFEFSKATSIFVSNHELFQEICDESRFDKYIGTSLNKVRAFAGDGLFTSWTEEPNWRKAHHILMPAFSQQAMKGYHEMMLDIATQLVQKWQRTGRDEEIEVAEDMTKLTLDTIGLCGFDFRFNSFYKENQHPFIESMVNGLSEAMDQASRLPVADKLMIKRRKKFEENVDFMKQLVDDIIQERKKQDKTGDDLLSLMLHAKDPETGERLSDENIRYQIITFLIAGHETTSGLLSFAIYFLLKNPEKLKKAVQEADDVLQGGLPTFKQVQKLNYTRMVLNESLRLWPTAPTFSLYAKEDTVIGGKYSIEKNQSVSVLLPKLHRDQAVWGEDAEEFKPERFLHPEKIPQHAYKPFGNGQRACIGMQFALHEATMVLAMVLHNLELIDHTSYELDLKESLTIKPNDFKIKVRPRKQQLFMVPPKEETKKSTTTDESKVKSHGTPLLVLYGSNLGTAQQIANELAEEGKAKGFDVTTAPLDDYTRQLPDKGAVFIVTASYNGHPPDHAKKFVDWVTQEKEQDLTNVTFAVFGCGDRNWASTYQRIPRLIDEALERKGAKRAADLGEGDAGGDMDEDKEAFQKTVFKQLAKEFQLTFQEKGKENPKLSVAYTNELVERPVAKTYGAFSAVVLKNEELQSEKSERQTRHIELQLPEGKKYKEGDHIGIVPKNSDALVQRVINRFNLDPKQHIKLYSEKKANHLPLDQPIQMRELLASHVELQEPATRTQLRELAAYTVCPPHRVELEQMAGEAYQEAILKKRVTMLDLLDQYEACELSFVHFLALLPGLKPRYYSISSSPKVDEKRVSITVAVVKGKAWSGRGEYAGVASNYLCGLKEGEEVACFLHEAQAGFQLPPSSEVPMIMIGPGTGIAPFRGFVQAREVWQKEGKPLGEAHLYFGCRHPHEDDLYFEEMQLAAQKGVVHIHRAYSRHKEQKVYVQHLLKEDGGMLIKLLDQGAYLYVCGDGKVMAPDVEATLIDLYQHEKQCSKEAAENWLTTLANNNRYVKDVWS

SEQ ID NO: 35 - protein, 768 aa, Rhodococcus equi
MSACPIDHKALQNMGCPVSANAAAFDPFTGPYQVDPAASLRWSRDEEPVFYSPELGYWVVTRYEDVKSVFRDNILFSPSIALEKITPVSEEATATLAKYDYAMARTMVNEDEPAHMPRRRALMDPFTPKELVHHEPMVRRLTREYVDRFIDTGRADLVDEMLWEVPLTVALHFLGVPEEDMDELRSYSIAHTVNTWGRPAVEEQVAVAEAVGKFWQYAGTVLEKMRKDPSGHGWMPFGIRVQQEQPDVVTDSYLHSMMMAGIVAAHETTANASANAFRLLLENRSVWEEICADPSLIPNAVEECLRHSGSVAAWRRLVTDDTTIGGIDIPKGSKLLIVTSSANHDERHFDNADDFDIRRENSSDHLTFGYGSHQCMGKNLARMEMQIFLEEFTKRIPHMELVPDQEFTYLPNTSFRGPDHVLVQWDPAKNPERADPSILDERQPVKIGEPSKTNISRTVTVDAVTPVADGVVRVTLSDPSGKPLPKWTPGSHIDVELGDLSRQYSLCSDPNDLSHYEIAVLEEPESRGGSRYVHRTLQAGHTLKMRGPRNHFKLDPDAQRYIFVAGGIGITPVIAMADHAKATGKDYEIHYCGRDVATMALLDRLTADHGDKVEIHSSAAGNRLDIPALLATPVDGTQIYSCGPERLLTALEEATAHWPEDSLHVEHFTSNLATLDPANEHAFEVELRDSGLTIQVAADQTVLDALRASNIDIQSDCEEGLCGSCEAPVLDGEVDHRDMVLTKTERAQNKSMMTCCSRACGKKISLAL

SEQ ID NO: 36 - protein, 1120 aa, Aspergillus fumigatus
MSESKTVPIPGPRGVPLLGNIYDIEQEVPLRSINLMADQYGPIYRLTTFGWSRVFVSTHELVDEVCDEERFTKVVTAGLNQIRNGVHDGLFTANFPGEENWAIAHRVLVPAFGPLSIRGMFDEMYDIATQLVMKWARHGPTVPIMVTDDFTRLTLDTIALCAMGTRFNSFYHEEMHPFVEAMVGLLQGSGDRARRPALLNNLPTSENSKYWDDIAFLRNLAQELVEARRKNPEDKKDLLNALILGRDPKTGKGLTDESIIDNMITFLIAGHETTSGLLSFLFYYLLKTPNAYKKAQEEVDSVVGRRKITVEDMSRLPYLNAVMRETLRLRSTAPLIAVHAHPEKNKEDPVTLGGGKYVLNKDEPIVIILDKLHRDPQVYGPDAEEFKPERMLDENFEKLPKNAWKPFGNGMRACIGRPFAWQEALLVVAILLQNFNFQMDDPSYNLHIKQTLTIKPKDFHMRATLRHGLDATKLGIALSGSADRAPPESSGAASRVRKQATPPAGQLKPMHIFFGSNTGTCETFARRLADDAVGYGFAADVQSLDSAMQNVPKDEPVVFITASYEGQPPDNAAHFFEWLSALKENELEGVNYAVFGCGHHDWQATFHRIPKAVNQLVAEHGGNRLCDLGLADAANSDMFTDFDSWGESTFWPAITSKFGGGKSDEPKPSSSLQVEVSTGMRASTLGLQLQEGLVIDNQLLSAPDVPAKRMIRFKLPSDMSYRCGDYLAVLPVNPTSVVRRAIRRFDLPWDAMLTIRKPSQAPKGSTSIPLDTPISAFELLSTYVELSQPASKRDLTALADAAITDADAQAELRYLASSPTRFTEEIVKKRMSPLDLLIRYPSIKLPVGDFLAMLPPMRVRQYSISSSPLADPSECSITFSVLNAPALAAASLPPAERAEAEQYMGVASTYLSELKPGERAHIAVRPSHSGFKPPMDLKAPMIMACAGSGLAPFRGFIMDRAEKIRGRRSSVGADGQLPEVEQPAKAILYVGCRTKGKDDIHATELAEWAQLGAVDVRWAYSRPEDGSKGRHVQDLMLEDREELVSLFDQGARIYVCGSTGVGNGVRQACKDIYLERRRQLRQAARERGEEVPAEEDEDAAAEQFLDNLRTKERYATDVFT

SEQ ID NO: 37 - protein, 1083 aa, Aspergillus nidulans
MAEIPEPKGLPLIGNIGTIDQEFPLGSMVALAEEHGEIYRLRFPGRTVVVVSTHALVNETCDEKRFRKSVNSALAHVREGVHDGLFTAKMGEVNWEIAHRVLMPAFGPLSIRGMFDEMHDIASQLALKWARYGPDCPIMVTDDFTRLTLDTLALCSMGYRFNSYYSPVLHPFIEAMGDFLTEAGEKPRRPPLPAVFFRNRDQKFQDDIAVLRDTAQGVLQARKEGKSDRNDLLSAMLRGVDSQTGQKMTDESIMDNLITFLIAGHETTSGLLSFVFYQLLKHPETYRTAQQEVDNVVGQGVIEVSHLSKLPYINSVLRETLRLNATIPLFTVEAFEDTLLAGKYPVKAGETIVNLLAKSHLDPEVYGEDALEFKPERMSDELFNARLKQFPSAWKPFGNGMRACIGRPFAWQEALLVMAMLLQNFDFSLADPNYDLKFKQTLTIKPKDMFMKARLRHGLTPTTLERRLAGLAVESATQDKIVTNPADNSVTGTRLTILYGSNSGTCETLARRIAADAPSKGFHVMRFDGLDSGRSALPTDHPVVIVTSSYEGQPPENAKQFVSWLEELEQQNESLQLKGVDFAVFGCFKEWAQTFHRIPKLVDSLLEKLGGSRLTDLGLADVSTDELFSTFETWADDVLWPRLVAQYGADGKTQAHGSSAGHEAASNAAVEVTVSNSRTQALRQDVGQAMVVETRLLTAESEKERRKKHLEIRLPDGVSYTAGDYLAVLPINPPETVRRAMRQFKLSWDAQITIAPSGPTTALPTDGPIAANDIFSTYVELSQPATRKDLRIMADATTDPDVQKILRTYANETYTAEILTKSISVLDILEQHPAIDLPLGTFLLMLPSMRMRQYSISSSPLLTPTTATITISVLDAPSRSRSNGSRHLGVATSYLDSLSVGDHLQVTVRKNPSSGFRLPSEPETTPMICIAAGSGIAPFRAFLQERAVMMEQDKDRKLAPALLFFGCRAPGIDDLYREQLEEWQARGVVDARWAFSRQSDDTKGCRHVDDRILADREDVVKLWRDGARVYVCGSGALAQSVRSAMVTVLRDEMETTGDGSDNGKAEKWFDEQRNVRYVMDVFD

SEQ ID NO: 38 - protein, 1054 aa, Aspergillus oryzae
MRQNDNEKQICPIPGPQGLPFLGNILDIDLDNGTMSTLKIAKTYYPIFKFTFAGETSIVINSVALLSELCDETRFHKHVSFGLELLRSGTHDGLFTAYDHEKNWELAHRLLVPAFGPLRIREMFPQMHDIAQQLCLKWQRYGPRRPLNLVDDFTRTTLDTIALCAMGYRFNSFYSEGDFHPFIKSMVRFLKEAETQATLPSFISNLRVRAKRRTQLDIDLMRTVCREIVTERRQTNLDHKNDLLDTMLTSRDSLSGDALSDESIIDNILTFLVAGHETTSGLLSFAVYYLLTTPDAMAKAAHEVDDVVGDQELTIEHLSMLKYLNAILRETLRLMPTAPGFSVTPYKPEIIGGKYEVKPGDSLDVFLAAVHRDPAVYGSDADEFRPERMSDEHFQKLPANSWKPFGNGKRSCIGRAFAWQEALMILALILQSFSLNLVDRGYTLKLKESLTIKPDNLWAYATPRPGRNVLHTRLALQTNSTHPEGLMSLKHETVESQPATILYGSNSGTCEALAHRLAIEMSSKGRFVCKVQPMDAIEHRRLPRGQPVIIITGSYDGRPPENARHFVKWLQSLKGNDLEGIQYAVFGCGLPGHHDWSTTFYKIPTLIDTIMAEHGGARLAPRGSADTAEDDPFAELESWSERSVWPGLEAAFDLVRHNSSDGTGKSTRITIRSPYTLRAAHETAVVHQVRVLTSAETTKKVHVELALPDTINYRPGDHLAILPLNSRQSVQRVLSLFQIGSDTILYMTSSSATSLPTDTPISAHDLLSGYVELNQVATPTSLRSLAAKATDEKTAEYLEALATDRYTTEVRGNHLSLLDILESYSVPSIEIQHYIQMLPLLRPRQYTISSSPRLNRGQASLTVSVMERADVGGPRNCAGVASNYLASCTPGSILRVSLRQANPDFRLPDESCSHPIIMVAAGSGIAPFRAFVQERSVRQKEGIILPPAFLFFGCRRADLDDLYREELDAFEEQGVVTLFRAFSRAQSESHGCKYVQDLLWMERVRVKTLWGQDAKVFVCGSVRMNEGVKAIISKIVSPTPTEELARRYIAETFI

SEQ ID NO: 39 - protein, 1103 aa, Aspergillus oryzae
MSTPKAEPVPIPGPRGVPLMGNILDIESEIPLRSLEMMADTYGPIYRLTTFGFSRCMISSHELAAEVFDEERFTKKIMAGLSELRHGIHDGLFTAHMGEENWEIAHRVLMPAFGPLNIQNMFDEMHDIATQLVMKWARQGPKQKIMVTDDFTRLTLDTIALCAMGTRFNSFYSEEMHPFVDAMVGMLKTAGDRSRRPGLVNNLPTTENNKYWEDIDYLRNLCKELVDTRKKNPTDKKDLLNALINGRDPKTGKGMSYDSIIDNMITFLIAGHETTSGSLSFAFYNMLKNPQAYQKAQEEVDRVIGRRRITVEDLQKLPYITAVMRETLRLTPTAPAIAVGPHPTKNHEDPVTLGNGKYVLGKDEPCALLLGKIQRDPKVYGPDAEEFKPERMLDEHFNKLPKHAWKPFGNGMRACIGRPFAWQEALLVIAMLLQNFNFQMDDPSYNIQLKQTLTIKPNHFYMRAALREGLDAVHLGSALSASSSEHADHAAGHGKAGAAKKGADLKPMHVYYGSNTGTCEAFARRLADDATSYGYSAEVESLDSAKDSIPKNGPVVFITASYEGQPPDNAAHFFEWLSALKGDKPLDGVNYAVFGCGHHDWQTTFYRIPKEVNRLVGENGANRLCEIGLADTANADIVTDFDTWGETSFWPAVAAKFGSNTQGSQKSSTFRVEVSSGHRATTLGLQLQEGLVVENTLLTQAGVPAKRTIRFKLPTDTQYKCGDYLAILPVNPSTVVRKVMSRFDLPWDAVLRIEKASPSSSKHISIPMDTQVSAYDLFATYVELSQPASKRDLAVLADAAAVDPETQAELQAIASDPARFAEISQKRISVLDLLLQYPSINLAIGDFVAMLPPMRVRQYSISSSPLVDPTECSITFSVLKAPSLAALTKEDEYLGVASTYLSELRSGERVQLSVRPSHTGFKPPTELSTPMIMACAGSGLAPFRGFVMDRAEKIRGRRSSGSMPEQPAKAILYAGCRTQGKDDIHADELAEWEKIGAVEVRRAYSRPSDGSKGTHVQDLMMEDKKELIDLFESGARIYVCGTPGVGNAVRDSIKSMFLERREEIRRIAKEKGEPVSDDDEETAFEKFLDDMKTKERYTTDIFA

SEQ ID NO: 40 - protein, 1066 aa, Fusarium oxysporum
MAESVPIPEPPGYPLIGNLGEFTSNPLSDLNRLADTYGPIFRLRLGAKAPIFVSSNSLINEVCDEKRFKKTLKSVLSQVREGVHDGLFTAFEDEPNWGKAHRILVPAFGPLSIRGMFPEMHDIATQLCMKFARHGPRTPIDTSDNFTRLALDTLALCAMDFRFYSYYKEELHPFIEAMGDFLTESGNRNRRPPFAPNFLYRAANEKFYGDIALMKSVADEVVAARKASPSDRKDLLAAMLNGVDPQTGEKLSDENITNQLITFLIAGHETTSGTLSFAMYQLLKNPEAYSKVQKEVDEVVGRGPVLVEHLTKLPYISAVLRETLRLNSPITAFGLEAIDDTFLGGKYLVKKGEIVTALLSRGHVDPVVYGNDADKFIPERMLDDEFARLNKEYPNCWKPFGNGKRACIGRPFAWQESLLAMVVLFQNFNFTMTDPNYALEIKQTLTIKPDHFYINATLRHGMTPTELEHVLAGNGATSSSTHNIKAAANLDAKAGSGKPMAIFYGSNSGTCEALANRLASDAPSHGFSATTVGPLDQAKQNLPEDRPVVIVTASYEGQPPSNAAHFIKWMEDLDGNDMEKVSYAVFACGHHDWVETFHRIPKLVDSTLEKRGGTRLVPMGSADAATSDMFSDFEAWEDIVLWPGLKEKYKISDEESGGQKGLLVEVSTPRKTSLRQDVEEALVVAEKTLTKSGPAKKHIEIQLPSAMTYKAGDYLAILPLNPKSTVARVFRRFSLAWDSFLKIQSEGPTTLPTNVAISAFDVFSAYVELSQPATKRNILALAEATEDKDTIQELERLAGDAYQAEISPKRVSVLDLLEKFPAVALPISSYLAMLPPMRVRQYSISSSPFADPSKLTLTYSLLDAPSLSGQGRHVGVATNFLSHLTAGDKLHVSVRASSEAFHLPSDAEKTPIICVAAGTGLAPLRGFIQERAAMLAAGRTLAPALLFFGCRNPEIDDLYAEEFERWEKMGAVDVRRAYSRATDKSEGCKYVQDRVYHDRADVFKVWDQGAKVFICGSREIGKAVEDVCVRLAIEKAQQNGRDVTEEMARAWFERSRNERFATDVFD

SEQ ID NO: 41 - protein, 1115 aa, Gibberella moniliformis
MSATALFTRRSVSTSNPELRPIPGPKPLPLLGNLFDFDFDNLTKSLGELGKIHGPIYSITFGASTEIMVTSREIAQELCDETRFCKLPGGALDVMKAVVGDGLFTAETSNPKWAIAHRIITPLFGAMRIRGMFDDMKDICEQMCLRWARFGPDEPLNVCDNMTKLTLDTIALCTIDYRFNSFYRENGAAHPFAEAVVDVMTESFDQSNLPDFVNNYVRFRAMAKFKRQAAELRRQTEELIAARRQNPVDRDDLLNAMLSAKDPKTGEGLSPESIVDNLLTFLIAGHETTSSLLSFCFYYLLENPHVLRRVQQEVDTVVGSDTITVDHLSSMPYLEAVLRETLRLRDPGPGFYVKPLKDEVVAGKYAVNKDQPLFIVFDSVHRDQSTYGADADEFRPERMLKDGFDKLPPCAWKPFGNGVRACVGRPFAMQQAILAVAMVLHKFDLVKDESYTLKYHVTMTVRPVGFTMKVRLRQGQRATDLAMGLHRGHSQEASAAASPSRASLKRLSSDVNGDDTDHKSQIAVLYASNSGSCEALAYRLAAEATERGFGIRAVDVVNNAIDRIPVGSPVILITASYNGEPADDAQEFVPWLKSLESGRLNGVKFAVFGNGHRDWANTLFAVPRLIDSELARCGAERVSLMGVSDTCDSSDPFSDFERWIDEKLFPELETPHGPGGVKNGDRAVPRQELQVSLGQPPRITMRKGYVRAIVTEARSLSSPGVPEKRHLELLLPKDFNYKAGDHVYILPRNSPRDVVRALSYFGLGEDTLITIRNTARKLSLGLPLDTPITATDLLGAYVELGRTASLKNLWTLVDAAGHGSRAALLSLTEPERFRAEVQDRHVSILDLLERFPDIDLSLSCFLPMLAQIRPRAYSFSSAPDWKPGHATLTYTVVDFATPATQGINGSSKSKAVGDGTAVVQRQGLASSYLSSLGPGTSLYVSLHRASPYFCLQKSTSLPVIMVGAGTGLAPFRAFLQERRMAAEGAKQRFGPALLFFGCRGPRLDSLYSVELEAYETIGLVQVRRAYSRDPSAQDAQGCKYVTDRLGKCRDEVARLWMDGAQVLVCGGKKMANDVLEVLGPMLLEIDQKRGETTAKTVVEWRARLDKSRYVEEVYV

SEQ ID NO: 42 - protein, 1066 aa, Gibberella zeae; identical to SEQ ID NO: 40

SEQ ID NO: 43 - protein, 1066 aa, Gibberella zeae
MAIKDGGKKSGQIPGPKGLPVLGNLFDLDLSDSLTSLINIGQKYAPIFSLELGGHREVMICSRDLLDELCDETRFHKIVTGGVDKLRPLAGDGLFTAQHGNHDWGIAHRILMPLFGPLKIREMFDDMQDVSEQLCLKWARLGPSATIDVANDFTRLTLDTIALCTMGYRFNSFYSNDKMHPFVDSMVAALIDADKQSMFPDFIGACRVKALSAFRKHAAIMKGTCNELIQERRKNPIEGTDLLTAMMEGKDPKTGEGMSDDLIVQNLITFLIAGHETTSGLLSFAFYYLLENPHTLEKARAEVDEVVGDQALNVDHLTKMPYVNMILRETLRLMPTAPGFFVTPHKDEIIGGKYAVPANESLFCFLHLIHRDPKVWGADAEEFRPERMADEFFEALPKNAWKPFGNGMRGCIGREFAWQEAKLITVMILQNFELSKADPSYKLKIKQSLTIKPDGFNMHAKLRNDRKVSGLFKAPSLSSQQPSLSSRQSINAINAKDLKPISIFYGSNTGTCEALAQKLSADCVASGFMPSKPLPLDMATKNLSKDGPNILLAASYDGRPSDNAEEFTKWAESLKPGELEGVQFAVFGCGHKDWVSTYFKIPKILDKCLADAGAERLVEIGLTDASTGRLYSDFDDWENQKLFTELSKRQGVTPTDDSHLELNVTVIQPQNNDMGGNFKRAEVVENTLLTYPGVSRKHSLLLKLPKDMEYTPGDHVLVLPKNPPQLVEQAMSCFGVDSDTALTISSKRPTFLPTDTPILISSLLSSLVELSQTVSRTSLKRLADFADDDDTKACVERIAGDDYTVEVEEQRMSLLDILRKYPGINMPLSTFLSMLPQMRPRTYSFASAPEWKQGHGMLLFSVVEAEEGTVSRPGGLATNYMAQLRQGDSILVEPRPCRPELRTTMMLPEPKVPIIMIAVGAGLAPFLGYLQKRFLQAQSQRTALPPCTLLFGCRGAKMDDICRAQLDEYSRAGVVSVHRAYSRDPDSQCKYVQGLVTKHSETLAKQWAQGAIVMVCSGKKVSDGVMNVLSPILFAEEKRSGMTGADSVDVWRQNVPKERMILEVFG

SEQ ID NO: 44 - protein, 1130 aa, Magnaporthe grisea
MFFLSSSLAYMAATQSRDWASFGVSLPSTALGRHLQAAMPFLSEENHKSQGTVLIPDAQGPIPFLGSVPLVDPELPSQSLQRLARQYGEIYRFVIPGRQSPILVSTHALVNELCDEKRFKKKVAAALLGLREAIHDGLFTAHNDEPNWGIAHRILMPAFGPMAIKGMFDEMHDVASQMILKWARHGSTTPIMVSDDFTRLTLDTIALCSMGYRFNSFYHDSMHEFIEAMTCWMKESGNKTRRLLPDVFYRTTDKKWHDDAEILRRTADEVLKARKENPSGRKDLLTAMIEGVDPKTGGKLSDSSIIDNLITFLIAGHETTSGMLSFAFYLLLKNPTAYRKAQQEIDDLCGREPITVEHLSKMPYITAVLRETLRLYSTIPAFVVEAIEDTVVGGKYAIPKNHPIFLMIAESHRDPKVYGDDAQEFEPERMLDGQFERRNREFPNSWKPFGNGMRGCIGRAFAWQEALLITAMLLQNFNFVMHDPAYQLSIKENLTLKPDNFYMRAILRHGMSPTELERSISGVAPTGNKTPPRNATRTSSPDPEDGGIPMSIYYGSNSGTCESLAHKLAVDASAQGFKAETVDVLDAANQKLPAGNRGPVVLITASYEGLPPDNAKHFVEWLENLKGGDELVDTSYAVFGCGHQDWTKTFHRIPKLVDEKLAEHGAVRLAPLGLSNAAHGDMFVDFETWEFETLWPALADRYKTGAGRQDAAATDLTAALSQLSVEVSHPRAADLRQDVGEAVVVAARDLTAPGAPPKRHMEIRLPKTGGRVHYSAGDYLAVLPVNPKSTVERAMRRFGLAWDAHVTIRSGGRTTLPTGAPVSAREVLSSYVELTQPATKRGIAVLAGAVTGGPAAEQEQAKAALLDLAGDSYALEVSAKRVGVLDLLERFPACAVPFGTFLALLPPMRVRQYSISSSPLWNDEHATLTYSVLSAPSLADPARTHVGVASSYLAGLGEGDHLHVALRPSHVAFRLPSPETPVVCVCAGSGMAPFRAFAQERAALVGAGRKVAPLLLFFGCREPGVDDLYREELEGWEAKGVLSVRRAYSRRTEQSEGCRYVQDRLLKNRAEVKSLWSQDAKVFVCGSREVAEGVKEAMFKVVAGKEGSSEEVQAWYEEVRNVRYASDIFD

SEQ ID NO: 45 - protein, 1108 aa, Neurospora crassa
MSSDETPQTIPIPGPPGLPLVGNSFDIDTEFPLGSMLNFADQYGEIFRLNFPGRNTVFVTSQALVHELCDEKRFQKTVNSALHEIRHGIHDGLFTARNDEPNWGIAHRILMPAFGPMAIQNMFPEMHEIASQLALKWARHGPNQSIKVTDDFTRLTLDTIALCSMDYRFNSYYHDDMHPFIDAMASFLVESGNRSRRPALPAFMYSKVDRKFYDDIRVLRETAEGVLKSRKEHPSERKDLLTAMLDGVDPKTGGKLSDDSIIDNLITFLIAGHETTSGLLSFAFVQLLKNPETYRKAQKEVDDVCGKGPIKLEHMNKLHYIAAVLRETLRLCPTIPVIGVESKEDTVIGGKYEVSKGQPFALLFAKSHVDPAVYGDTANDFDPERMLDENFERLNKEFPDCWKPFGNGMRACIGRPFAWQEALLVMAVCLQNFNFMPEDPNYTLQYKQTLTTKPKGFYMRAMLRDGMSALDLERRLKGELVAPKPTAQGPVSGQPKKSGEGKPISIYYGSNTGTCETFAQRLASDAEAHGFTATIIDSLDAANQNLPKDRPVVFITASYEGQPPDNAALFVGWLESLTGNELEGVQYAVFGCGHHDWAQTFHRIPKLVDNTVSERGGDRICSLGLADAGKGEMFTEFEQWEDEVFWPAMEEKYEVSRKEDDNEALLQSGLTVNFSKPRSSTLRQDVQEAVVVDAKTITAPGAPPKRHIEVQLSSDSGAYRSGDYLAVLPINPKETVNRVMRRFQLAWDTNITIEASRQTTILPTGVPMPVHDVLGAYVELSQPATKKNILALAEAADNAETKATLRQLAGPEYTEKITSRRVSILDLLEQFPSIPLPFSSFLSLLPPMRVRQYSISSSPLWNPSHVTLTYSLLESPSLSNPDKKHVGVATSYLASLEAGDKLNVSIRPSHKAFHLPVDADKTPLIMIAAGSGLAPFRGFVQERAAQIAAGRSLAPAMLFYGCRHPEQDDLYRDEFDKWESIGAVSVRRAFSRCPESQETKGCKYVGDRLWEDREEVTGLWDRGAKVYVCGSREVGESVKKVVVRIALERQKMIVEAREKGELDSLPEGIVEGLKLKGLTVEDVEVSEERALKWFEGIRNERYATDVFD

SEQ ID NO: 46 - protein, 1073 aa, Streptomyces avermitilis
MTTQPETDLRPIRSPRGVPLFGHTPQIPSTNPVEYFGKLSKQFPEGLYGMEIAGIEQVFVWDPDLVAEVCDETRFFKQIDKTPLAHVRDYAGAGLFTAHQHEEEWGMAHRVLLPVFSQRAMKGYFGQMLEIAQNLVGKWERKEGQPVNITDDYTRLTLDTIALSGFGYRFDSFAKEDLHPFLNALLQALVESLRRSQELPVMTKMRKADDKKYRENIRLMRDLVENVIKERREGKGTGEDDLLGLMLEATDPETGKGLDDDNVRDQVVTFLIAGHETTSGLLSFATYSLMRNPHILAQAYAEVDRLLPGDTVPDYDTIMQMDVIPRILEETLRLWAPIPMIGKSPLEDTVIGGCYGLKKGARVNILEGPLHTHPKAWERPEEFDINRWLPENRVNHHPHAYKPFGNGVRACIGRQFALTEARLALALVLQKFKFADTDDYKMDVKEALTRKPGGFELNVRARQEHERTVFGAADLQTDDTQAQAAVSGVGVNLTVAYGSSLGSCEDLARTIADRGERSGFGTTLVGLDELGDNLPTEGLLVVVASSYNGKAPDNAQRFDDLLAAGLPEGSLSNVRFALLGAGNTQWVATYQGFPKRIEAGLLAAGATRVIERGIADAAGDFDGMATRWMDTLWTTLAEEYAADTSETTGPRFEVQLLTEAEVRPAIVSEQAYPLTVVANEELVSDATGLWDFSIEPPRPAAKSITIELPDGVTYDTGNHLAVFAKNEPVLVNRALARLGVDRDQVLRLDQPGGGRTHLPVGTPVTTGLLFTEFVELQDVATRSQIQELAEHTQCPWTRPQLQAYTADTAEAEERYQKEILGKRVSVLNLLERFPAVELPLAVFLEMMGPIRPRFYSISSSPLANPRHVRLTVGLLEGPALSGDGRYRGTCSSYIAGLESGDVFYGYVRVPSPTFAPPADPATPLLLIGPGTGIAPLRGFLEERAHQHAHGTQVGLSQVFVGCRHPEHDYFYRQEMQDWEQAGIAQVHTAFSAVTGHPARFVQDAIVGAADTVWQAIQDGAYVYVCGDGRRMAPAVREALAAIYRKHTGSDDEAAQQWLAQLEADERYQQDVFA

SEQ ID NO: 47 - protein, 1064 aa, Ralstonia metallidurans
MSTATPAAALEPIPRDPGWPIFGNLFQITPGEVGQHLLARSRHHDGIFELDFAGKRVPFVSSVALASELCDATRFRKIIGPPLSYLRDMAGDGLFTAHSDEPNWGCAHRILMPAFSQRAMKAYFDVMLRVANRLVDKWDRQGPDADIAVADDMTRLTLDTIALAGFGYDFASFASDELDPFVMAMVGALGEAMQKLTRLPIQDRFMGRAHRQAAEDIAYMRNLVDDVIRQRRVSPTSGMDLLNLMLEARDPETDRRLDDANIRNQVITFLIAGHETTSGLLTFALYELLRNPGVLAQAYAEVDTVLPGDALPVYADLARMPVLDRVLKETLRLWPTAPAFAVAPFDDVVLGGRYRLRKDRRISVVLTALHRDPKVWANPERFDIDRFLPENEAKLPAHAYMPFGQGERACIGRQFALTEAKLALALMLRNFAFQDPHDYQFRLKETLTIKPDQFVLRVRRRRPHERFVTRQASQAVADAAQTDVRGHGQAMTVLCASSLGTARELAEQIHAGAIAAGFDAKLADLDDAVGVLPTSGLVVVVAATYNGRAPDSARKFEAMLDADDASGYRANGMRLALLGCGNSQWATYQAFPRRVFDFFITAGAVPLLPRGEADGNGDFDQAAERWLAQLWQALQADGAGTGGLGVDVQVRSMAAIRAETLPAGTQAFTVLSNDELVGDPSGLWDFSIEAPRTSTRDIRLQLPPGITYRTGDHIAVWPQNDAQLVSELCERLDLDPDAQATISAPHGMGRGLPIDQALPVRQLLTHFIELQDVVSRQTLRALAQATRCPFTKQSIEQLASDDAEHGYATKVVARRLGILDVLVEHPAIALTLQELLACTVPMRPRLYSIASSPLVSPDVATLLVGTVCAPALSGRGQFRGVASTWLQHLPPGARVSASIRTPNPPFAPDPDPAAPMLLIGPGTGIAPFRGFLEERALRKMAGNAVTPAQLYFGCRHPQHDWLYREDIERWAGQGVVEVHPAYSVVPDAPRYVQDLLWQRREQVWAQVRDGATIYVCGDGRRMAPAVRQTLIEIGMAQGGMTDKAASDWFGGLVAQGRYRQDVFN

SEQ ID NO: 48 - protein, 1005 aa, Actinosynnema pretiosum
MVATGTRIPGPKPLPLVGNLLDVLTSDLDTDVDFLDRCHREHGGIVALTFAGQRQVFASSHELVARMCSDPSWGKAVHPALEQVRDFAGDGLFTARGDEPNWGKAHRLLMPAFGPTAMRDHFPAMLDIAEQMLVRWRRFGPDHRIDVADDMTRLTLDTIALCAFGARFNSFYRDRAHPFVDAMVRSLVEAGERAERLPGVQPFLVGRNQRYRDDIATMNRIADGIVAARAALPAGERPDDLLERMLTCADPVTGERLSARNVRYQLATFLIAGHETTSGLLSFAVHRLLAHPEVLRKAKDAVDGVLGDRVPAFEDLARLDYLGQVLRETLRLHPTAPAFALAPDEPAELGGHAIGAGEPVLVMLPTLHRDPAVWRDPDVFDPERFAPERMDEIPACAWMPFGHGARACIGRPFALQEATLVLALVLQRFDLALADPDHRLTIKQTLTLKPDSLVVRARPRADRPGATATVETVVPHQVPATHRHGTPLHVFYGSNGGSGEGLARTIAGDGAARGWATSVAPLDDAVRALPASGPVVIVSSSYNGAPPDNAAHFVRWLTQDGPDLSGVDYLVLGCGNLDWSATYQRVPTLIDEAMAAAGARRLRERGATDARADFFGDWERWYEPLWPLLSAECGVEVGEIGPRFRVVESDAADGLGDLASAVVLENRELVRGPDAGSKRHLELRLPDGTSYRTGDYLSVLPQNHPDLVRRAVARLGTRAERVVTVESSAPTGLVPVGRALRVDELLTRCVDLSAPAGAGVVARLAERCPCPPERAELAATTGATLLELLERFPSCAVDLALALELLPAPRTRLYSISSAAEEQRAEVALTVSVTGVTSGYLSRVRPGDRVAVGIASPPESFRPPADNTVPVVLIAAGTGIAPFRGFLRARAALGGEPGPALLLFGCRGPELDDLYAEEFAALGDWLEVDRAYSRHPDGEVRHVQHRLWQRRDRVRELVDAGARVYLCGDATRVGPAVEEVLGRIGPGAGWLDALRAGGRYATDVF

SEQ ID NO: 49 - protein, 1061 aa, Saccharopolyspora erythraea
MTQTPLHHDDVPVADVSGTGLTATPTQQAMELARRHGPVFRRRTREFQSLLVSDVDLVAELSDEQRFAKAVGPALENVREFAADGLFTAYNDEFNWAKAHDILMPAFALGSMRTYHPVMLRVARRLLDSWDRAAAASAPVDVPDDMTRMTLDTIGLAGFGFDFGSFGRAEPHPFVGAMVRCLDWSMTRLSRVPGTDHSERDEAFRADARYLASVVDEVINTRAAEGDTSGEDLLGLMLGARHPADGTTLDAANIRNQIITFLIAGHETTSGTLSFALHYLAKNPTVLRLVQREADELWGDSPDPEPSFEDIGRLTYTRQVLNETLRLWPSAPAFGRQARHDTVLGGRIPMRAGEAAAVLIPMLHRSPVRGDNPELFDPARFAPEAEAARGPHAFKPFGTGERACIGRQFALDEATMVLAMLAHRYRLVDHAGYRLKVKETLTLKPEGLTLAVRARTAADRVTNRLALPVGLPSAAPGEPADAARRPGRVLPGTGLLLLHGSNYGTCRDFAAQLALAAGELGCDTAVAPLDEYAGNLPSDRPVIVVAASYNGRPTDDAVSFSRWLDEAEPGAADGVDFAVLGVGDRNWAATYQHVPTRIDARLAELGGTRILERGEADASGDLAGAVRRFSAALETALLERSGDPDAVAAAPEGDGPAYTVSEVTGGALDSLAARHGMVEMTVTEVADLTAPDYPRTKRFVRLALPEGTAYRTADHLAVLPVHDAALVERAAGVLGVDLDTVLDIRAKRPGRLTFDRSLTVRELLSHHVELQDPPTPDGLDALAALNPCPPERAALRGLAEEARSGTADHRTLWDLIEDHPALRDALSWSALLELLPATRPRQYSVSSSPAVDPRHVDLMVSVLRAPARSGRGEFRGAGSRHLSEVRPGDTVLARVQPCREDFRVAPDEPLIMVAAGTGLAPFRGVIADRRERVANGARQAPALCYFGCDAPDADYLHSAELRAAESAGAVAMRPAFNEAPVGGQCFVQHRIAAEAGEVWALLESGARVLVCGDGRHMAPGVREAFRGIYRERTPGADDASAHEWLQAMIAGGCYVEDVYAG

SEQ ID NO: 50 - protein, 1063 aa, Burkholderia sp.
MKSSSLVPQPPLKPVIGHLMEVLGPSPLAKMMDLARTYGPVYWFEVFGQGYYVVSGQTLVDEVCDETRFQKCVHQSLLELRPAIGDGLFTAFGDEPNWAKAHRVLMQAFGPLSIWSMFDKMVDIADQMFLHWERFGPETPVDVSDHMTRLTLDTIALCAFDCRFNSFYREDQHPFVDAMVNTLSEAGKRELRPKLVSKLMVKRSRQFDADIEVMRSLATKMIEDRRKNPHVNEESMDLLDRMLNGIDPVTGEKLDDENIVFQMITFLIAGHETTSGLLSFATYFLLKNPDILQKARDMVDEVVGSETPRIEHLARLRYVEQILMETLRIWPTAPGFAVKPLADTTFGGKYAVSPDDIIMILTPMLHRDVSVWGEDVEAFRPERFAPENAEQLPPNSWKPFGNGARACIGRPFAMQEAHLVLIMLLQRFDFSFADPDYELDVAETLTLKPAGFRVNVKPRARGALKVPDTALHARSNAQSPSVAPVQSIAPGEDLSNLLVLFGGNTGSAESFARRIAGDASRHGFHATCAPLDDFAGKLGGYPAIVIVTASYEGQPPDNAKSFVPYVEALDEGALDGVHFSVLGCGNKQWARTYQAIPKRVDEALEKAGATRVHFRGELDSGGDFFGEFDRWYTEMWNRFAISAGKEIPVIQHDDVALKVSFAGSSREKVLNLGDMAHASIVDNRELVDISVAGSRSKKHIELKLPEAMTYRSGDYLAVLPRNAKNNVDRVLRRFRVSWDTQVVIEGTSSNPRLPLGQAIGCGELFSSYVELAVPATRSQVSSLAAATRCPPEKVELERLSADGFECEILGKRTTVMDLLERFGSVDLSLEKFLDMLPALKARQYSISSSPLWKADHVTLTVAVVDAPALSGNGRHEGVASSYLARLNTGDSLSVAVRPSNARFRPPAEPDLPMILICAGSGIAPFRGFLQERALQKQRGENVGTSLLFFGIDDPDVDFLYRDELDEWARCGVVEVMPAYSNRPEEGARFVQDKVWLERERISALFSQGATVFVCGDGKNMAPAVRATLGRIYQETTGENDESASAWIDTMEREHGRYVADVFA

SEQ ID NO: 51 - protein, 416 aa, Pseudomonas putida
MMTTETIQSNANLAPLPPHVPEHLVFDFDMYNPSNLSAGVQEAWAVLQESNVPDLVWTRCNGGHWIATRGQLIREAYEDYRHFSSECPFIPREAGEAYDFIPTSMDPPEQRQFRALANQVVGMPVVDKLENRIQELACSLIESLRPQGQCNFTEDYAEPFPIRIFMLLAGLPEEDIPHLKYLTDQMTRPDGSMTFAEAKEALYDYLIPIIEQRRQKPGTDAISIVANGQVNGRPITSDEAKRMCGLLLVGGLDTVVNFLSFSMEFLAKSPEHRQELIERPERIPAACEELLRRFSLVADGRILTSDYEFHGVQLKKGDQILLPQMLSGLDERENACPMHVDFSRQKVSHTTFGHGSHLCLGQHLARREIIVTLKEWLTRIPDFSIAPGAQIQHKSGIVSGVQALPLVWDPATTKAV

SEQ ID NO: 52 - protein, 415 aa, Artificial Sequence
  Synthesized sequence
MTTETIQSNANLAPLPPHVPEHLVFDFDMYNPSNLSAGVQEAWAVLQESNVPDLVWTRCNGGHWIATRGQLIREAYEDYRHFSSECPFIPREAGEAADFIPTSMDPPEQRQFRALANQVVGMPVVDKLENRIQELACSLIESLRPQGQCNFTEDYAEPFPIRIFMLLAGLPEEDIPHLKYLTDQMTRPDGSMTFAEAKEALYDYLIPIIEQRRQKPGTDAISIVANGQVNGRPITSDEAKRMCGLLLVGGLDTVVNFLSFSMEFLAKSPEHRQELIERPERIPAACEELLRRFSLVADGRILTSDYEFHGVQLKKGDQILLPQMLSGLDERENACPMHVDFSRQKVSHTTFGHGSHLCLGQHLARREIIVTLKEWLTRIPDFSIAPGAQIQHKSGIVSGVQALPLVWDPATTKAV

SEQ ID NO: 53 - protein, 415 aa, Artificial Sequence
  Synthesized sequence
MTTETIQSNANLAPLPPHVPEHLVFDFDMYNPSNLSAGVQEAWAVLQESNVPDLVWTRCNGGHWIATRGQLIREAYEDYRHFSSECPFIPREAGEAFDFIPTSMDPPEQRQFRALANQVVGMPVVDKLENRIQELACSLIESLRPQGQCNFTEDYAEPFPIRIFMLLAGLPEEDIPHLKYLTDQMTRPDGSMTFAEAKEALYDYLIPIIEQRRQKPGTDAISIVANGQVNGRPITSDEAKRMCGLLLVGGLDTVVNFLSFSMEFLAKSPEHRQELIERPERIPAACEELLRRFSLVADGRILTSDYEFHGVQLKKGDQILLPQMLSGLDERENACPMHVDFSRQKVSHTTFGHGSHLCLGQHLARREIIVTLKEWLTRIPDFSIAPGAQIQHKSGIVSGVQALPLVWDPATTKAV

SEQ ID NO: 54 - protein, 415 aa, Artificial Sequence
  Synthesized sequence
MTTETIQSNANLAPLPPHVPEHLVFDFDMYNPSNLSAGVQEAWAVLQESNVPDLVWTRCNGGHWIATRGQLIREAYEDYRHFSSECPWIPREAGEAFDFIPTSMDPPEQRQFRALANQVVGMPVVDKLENRIQELACSLIESLRPQGQCNFTEDYAEPFPIRIFMLLAGLPEEDIPHLKYLTDQMTRPDGSMTFAEAKEALYDYLIPIIEQRRQKPGTDAISIVANGQVNGRPITSDEAKRMCGLLLVGGLDTVVNFLSFSMEFLAKSPEHRQELIERPERIPAACEELLRRFSLVADGRILTSDYEFHGVQLKKGDQILLPQMLSGLDERENACPMHVDFSRQKVSHTTFGHGSHLCLGQHLARREIIVTLKEWLTRIPDFSIAPGAQIQHKSGIVSGVQALPLVWDPATTKAV

SEQ ID NO: 55 - protein, 415 aa, Artificial Sequence
  Synthesized sequence
MTTETIQSNANLAPLPPHVPEHLVFDFDMYNPSNLSAGVQEAWAVLQESNVPDLVWTRCNGGHWIATRGQLIREAYEDYRHFSSECPFIPREAGEAFDFIPTSMDPPEQRQFRALANQVVGMPVVDKLENRIQELACSLIESLRPQGQCNFTEDYAEPFPIRIFMLLAGLPEEDIPHLKYLTDQMTRPDGSMTFAEAKEALYDYLIPIIEQRRQKPGTDAISIVANGQVNGRPITSDEAKRMCGLLLLGGLDTVVNFLSFSMEFLAKSPEHRQELIERPERIPAACEELLRRFSLVADGRILTSDYEFHGVQLKKGDQILLPQMLSGLDERENACPMHVDFSRQKVSHTTFGHGSHLCLGQHLARREIIVTLKEWLTRIPDFSIAPGAQIQHKSGIVSGVQALPLVWDPATTKAV

SEQ ID NO: 56 - protein, 415 aa, Artificial Sequence
  Synthesized sequence
MTTETIQSNANLAPLPPHVPEHLVFDFDMYNPSNLSAGVQEAWAVLQESNVPDLVWTRCNGGHWIATRGQLIREAYEDYRHFSSECPWIPREAGEAFDFIPTSMDPPEQRQFRALANQVVGMPVVDKLENRIQELACSLIESLRPQGQCNFTEDYAEPFPIRIFMLLAGLPEEDIPHLKYLTDQMTRPDGSMTFAEAKEALYDYLIPIIEQRRQKPGTDAISIVANGQVNGRPITSDEAKRMCGLLLLGGLDTVVNFLSFSMEFLAKSPEHRQELIERPERIPAACEELLRRFSLVADGRILTSDYEFHGVQLKKGDQILLPQMLSGLDERENACPMHVDFSRQKVSHTTFGHGSHLCLGQHLARREIIVTLKEWLTRIPDFSIAPGAQIQHKSGIVSGVQALPLVWDPATTKAV

SEQ ID NO: 57 - protein, 410 aa, Bacillus megaterium
MKEVIAVKEITRFKTRTEEFSPYAWCKRMLENDPVSYHEGTDTWNVFKYEDVKRVLSDYKHFSSVRKRTTISVGTDSEEGSVPEKIQITESDPPDHRKRRSLLAAAFTPRSLQNWEPRIQEIADELIGQMDGGTEIDIVASLASPLPIIVMADLMGVPSKDRLLFKKWVDTLFLPFDREKQEEVDKLKQVAAKEYYQYLYPIVVQKRLNPADDIISDLLKSEVDGEMFTDDEVVRTTMLILGAGVETTSHLLANSFYSLLYDDKEVYQELHENLDLVPQAVEEMLRFRFNLIKLDRTVKEDNDLLGVELKEGDSVVVWMSAANMDEEMFEDPFTLNIHRPNNKKHLTFGNGPHFCLGAPLARLEAKIALTAFLKKFKHIEAVPSFQLEENLTDSATGQTLTSLPLKASRM

SEQ ID NO: 58 - protein, 417 aa, Bacillus subtilis
MNEQIPHDKSLDNSLTLLKEGYLFIKNRTERYNSDLFQARLLGKNFICMTGAEAAKVFYDTDRFQRQNALPKRVQKSLFGVNAIQGMDGSAHIHRKMLFLSLMTPPHQKRLAELMTEEWKAAVTRWEKADEVVLFEEAKEILCRVACYWAGVPLKETEVKERADDFIDMVDAFGAVGPRHWKGRRARPRAEEWIEVMIEDARAGLLKTTSGTALHEMAFHTQEDGSQLDSRMAAIELINVLRPIVAISYFLVFSALALHEHPKYKEWLRSGNSREREMFVQEVRRYYPFGPFLGALVKKDFVWNNCEFKKGTSVLLDLYGTNHDPRLWDHPDEFRPERFAEREENLFDMIPQGGGHAEKGHRCPGEGITIEVMKASLDFLVHQIEYDVPEQSLHYSLARMPSLPESGFVMSGIRRKS

SEQ ID NO: 59 - protein, 404 aa, Citrobacter braakii
MTATVASTSLFTTADHYHTPLGPDGTPHAFFEALRDEAETTPIGWSEAYGGHWVVAGYKEIQAVIQNTKAFSNKGVTFPRYETGEFELMMAGQDDPVHKKYRQLVAKPFSPEATDLFTEQLRQSTNDLIDARIELGEGDAATWLANEIPARLTAILLGLPPEDGDTYRRWVWAITHVENPEEGAEIFAELVAHARTLIAERRTNPGNDIMSRVIMSKIDGESLSEDDLIGFFTILLLGGIDNTARFLSSVFWRLAWDIELRRRLIAHPELIPNAVDELLRFYGPAMVGRLVTQEVTVGDITMKPGQTAMLWFPIASRDRSAFDSPDNIVIERTPNRHLSLGHGIHRCLGAHLIRVEARVAITEFLKRIPEFSLDPNKECEWLMGQVAGMLHVPIIFPKGKRLSE

SEQ ID NO: 60 - protein, 428 aa, Pseudomonas sp.
MDARATIPEHIARTVILPQGYADDEVIYPAFKWLRDEQPLAMAHIEGYDPMWIATKHADVMQIGKQPGLFSNAEGSEILYDQNNEAFMRSISGGCPHVIDSLTSMDPPTHTAYRGLTLNWFQPASIRKLEENIRRIAQASVQRLLDFDGECDFMTDCALYYPLHVVMTALGVPEDDEPLMLKLTQDFFGVHEPDEQAVAAPRQSADEAARRFHETIATFYDYFNGFTVDRRSCPKDDVMSLLANSKLDGNYIDDKYINAYYVAIATAGHDTTSSSSGGAIIGLSRNPEQLALAKSDPALIPRLVDEAVRWTAPVKSFMRTALADTEVRGQNIKRGDRIMLSYPSANRDEEVFSNPDEFDITRFPNRHLGFGWGAHMCLGQHLAKLEMKIFFEELLPKLKSVELSGPPRLVATNFVGGPKNVPIRFTKA

SEQ ID NO: 61 - protein, 404 aa, Saccharopolyspora erythraea
MTTVPDLESDSFHVDWYRTYAELRETAPVTPVRFLGQDAWLVTGYDEAKAALSDLRLSSDPKKKYPGVEVEFPAYLGFPEDVRNYFATNMGTSDPPTHTRLRKLVSQEFTVRRVEAMRPRVEQITAELLDEVGDSGVVDIVDRFAHPLPIKVICELLGVDEKYRGEFGRWSSEILVMDPERAEQRGQAAREVVNFILDLVERRRTEPGDDLLSALIRVQDDDDGRLSADELTSIALVLLLAGFEASVSLIGIGTYLLLTHPDQLALVRRDPSALPNAVEEILRYIAPPETTTRFAAEEVEIGGVAIPQYSTVLVANGAANRDPKQFPDPHRFDVTRDTRGHLSFGQGIHFCMGRPLAKLEGEVALRALFGRFPALSLGIDADDVVWRRSLLLRGIDHLPVRLDG

SEQ ID NO: 62 - protein, 516 aa, Homo sapiens
MALSQSVPFSATELLLASAIFCLVFWVLKGLRPRVPKGLKSPPEPWGWPLLGHVLTLGKNPHLALSRMSQRYGDVLQIRIGSTPVLVLSRLDTIRQALVRQGDDFKGRPDLYTSTLITDGQSLTFSTDSGPVWAARRRLAQNALNTFSIASDPASSSSCYLEEHVSKEAKALISRLQELMAGPGHFDPYNQVVVSVANVIGAMCFGQHFPESSDEMLSLVKNTHEFVETASSGNPLDFFPILRYLPNPALQRFKAFNQRFLWFLQKTVQEHYQDFDKNSVRDITGALFKHSKKGPRASGNLIPQEKIVNLVNDIFGAGFDTVTTAISWSLMYLVTKPEIQRKIQKELDTVIGRERRPRLSDRPQLPYLEAFILETFRHSSFLPFTIPHSTTRDTTLNGFYIPKKCCVFVNQWQVNHDPELWEDPSEFRPERFLTADGTAINKPLSEKMMLFGMGKRRCIGEVLAKWEIFLFLAILLQQLEFSVPPGVKVDLTPIYGLTMKHARCEHVQARLRFSIN

SEQ ID NO: 63 - protein, 489 aa, Homo sapiens
MEPFVVLVLCLSFMLLFSLWRQSCRRRKLPPGPTPLPIIGNMLQIDVKDICKSFTNFSKVYGPVFTVYFGNPIVVFHGYEAVKEALIDNGEEFSGRGNSPISQRITKGLGIISSNGKRWKEIRRFSLTTLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFIDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 64 - protein, 490 aa, Homo sapiens [sequence omitted]

SEQ ID NO: 65 - protein, 490 aa, Homo sapiens
MDPFVVLVLCLSCLLLLSIWRQSSGRGKLPPGPTPLPVIGNILQIDIKDVSKSLTNLSKIYGPVFTLYFGLERMVVLHGYEVVKEALIDLGEEFSGRGHFPLAERANRGFGIVFSNGKRWKEIRRFSLMTLRNFGMGKRSIEDRVQEEARCLVEELRKTKASPCDPTFILGCAPCNVICSIIFQKRFDYKDQQFLNLMEKLNENIRIVSTPWIQICNNFPTIIDYFPGTHNKLLKNLAFMESDILEKVKEHQESMDINNPRDFIDCFLIKMEKEKQNQQSEFTIENLVITAADLLGAGTETTSTTLRYALLLLLKHPEVTAKVQEEIERVIGRNRSPCMQDRGHMPYTDAVVHEVQRYIDLIPTSLPHAVTCDVKFRNYLIPKGTTILTSLTSVLHDNKEFPNPEMFDPRHFLDEGGNFKKSNYFMPFSAGKRICVGEGLARMELFLFLTFILQNFNLKSLIDPKDLDTTPVVNGFASVPPFYQLCFIPV

SEQ ID NO: 66 - protein, 446 aa, Homo sapiens
MGLEALVPLAVIVAIFLLLVDLMHRRQRWAARYPPGPLPLPGLGNLLHVDFQNTPYCFDQLRRRFGDVFSLQLAWTPVVVLNGLAAVREALVTHGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLCIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 67 - protein, 493 aa, Homo sapiens
MSALGVTVALLVWAAFLLLVSMWRQVHSSWNLPPGPFPLPIIGNLFQLELKNIPKSFTRLAQRFGPVFTLYVGSQRMVVMHGYKAVKEALLDYKDEFSGRGDLPAFHAHRDRGIIFNNGPTWKDIRRFSLTTLRNYGMGKQGNESRIQREAHFLLEALRKTQGQPFDPTFLIGCAPCNVIADILFRKHFDYNDEKFLRLMYLFNENFHLLSTPWLQLYNNFPSFLHYLPGSHRKVIKNVAEVKEYVSERVKEHHQSLDPNCPRDLTDCLLVEMEKEKHSAERLYTMDGITVTVADLFFAGTETTSTTLRYGLLILMKYPEIEEKLHEEIDRVIGPSRIPAIKDRQEMPYMDAVVHEIQRFITLVPSNLPHEATRDTIFRGYLIPKGTVVVPTLDSVLYDNQEFPDPEKFKPEHFLNENGKFKYSDYFKPFSTGKRVCAGEGLARMELFLLLCAILQHFNLKPLVDPKDIDLSPIHIGFGCIPPRYKLCVIPRS

SEQ ID NO: 68 - protein, 491 aa, Homo sapiens
MDSISTAILLLLLALVCLLLTLSSRDKGKLPPGPRPLSILGNLLLLCSQDMLTSLTKLSKEYGSMYTVHLGPRRVVVLSGYQAVKEALVDQGEEFSGRGDYPAFFNFTKGNGIAFSSGDRWKVLRQFSIQILRNFGMGKRSIEERILEEGSFLLAELRKTEGEPFDPTFVLSRSVSNIICSVLFGSRFDYDDERLLTIIRLINDNFQIMSSPWGELYDIFPSLLDWVPGPHQRIFQNFKCLRDLIAHSVHDHQASLDPRSPRDFIQCFLTKMAEEKEDPLSHFHMDTLLMTTHNLLFGGTKTVSTTLHHAFLALMKYPKVQARVQEEIDLVVGRARLPALKDRAAMPYTDAVIHEVQRFADIIPMNLPHRVTRDTAFRGFLIPKGTDVITLLNTVHYDPSQFLTPQEFNPEHFLDANQSFKKSPAFMPFSAGRRLCLGESLARMELFLYLTAILQSFSLQPLGAPEDIDLTPLSSGLGNLPRPFQLCLRPR

SEQ ID NO: 69 - protein, 503 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKEMVPIIAQYGDVLVRNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 70 - protein, 420 aa, Mycobacterium sp. HXN1500
MTEMTVAASDATNAAYGMALEDIDVSNPVLFRDNTWHPYFKRLREEDPVHYCKSSMFGPYWSVTKYRDIMAVETNPKVFSSEAKSGGITIMDDNAAASLPMFIAMDPPKHDVQRKTVSPIVAPENLATMESVIRQRTADLLDGLPINEEFDWVHRVSIELTTKMLATLFDFPWDDRAKLTRWSDVTTALPGGGIIDSEEQRMAELMECATYFTELWNQRVNAEPKNDLISMMAHSESTRHMAPEEYLGNIVLLIVGGNDTTRNSMTGGVLALNEFPDEYRKLSANPALISSMVSEIIRWQTPLSHMRRTALEDIEFGGKHIRQGDKVVMWYVSGNRDPEAIDNPDTFIIDRAKPRQHLSFGFGIHRCVGNRLAELQLNILWEEILKRWPDPLQIQVLQEPTRVLSPFVKGYESLPVRINA

SEQ ID NO: 71 - protein, 416 aa, Sphingopyxis macrogoltabida
MEHTGQSAAATMPLDSIDVSIPELFYNDSVGEYFKRLRKDDPVHYCADSAFGPYWSITKYNDIMHVDTNHDIFSSDAGYGGIIIDDGIQKGGDGGLDLPNFIAMDRPRHDEQRKAVSPIVAPANLAALEGTIRERVSKTLDGLPVGEEFDWVDRVSIEITTQMLATLFDFPFEERRKLTRWSDVTTAAPGGGVVESWDQRKTELLECAAYFQVLWNERVNKDPGNDLISMLAHSPATRNMTPEEYLGNVLLLIVGGNDTTRNSMTGGVLALHKNPDQFAKLKANPALVETMVPEIIRWQTPLAHMRRTAIADSELGGKTIRKGDKVVMWYYSGNRDDEVIDRPEEFIIDRPRPRQHLSFGFGIHRCVGNRLAEMQLRILWEEILTRFSRIEVMAEPERVRSNFVRGYAKMMVRVHA

SEQ ID NO: 72 - protein, 419 aa, Sphingopyxis macrogoltabida
MDTDMVEPNIREKVAFIPIDEIDVARPSLFQKDTVGLFFERLRREEPVHYCRESYVGPYWSITKFDDIMAVDTNHKVFSSEAKLGGIAIEDMHSAKSALELEMFIAMDPPKHNQQRKAVTGAVAPSNLLLLEPTIRERACQILDDLPVGEDIDWVDKVAVELTTMTLATLFDFPWEERRKTRWSDVTTAAPETGIVASYEARRAELIECAMYFKGLWEQRINAEPKNDLISMMAHSPATRDMPFLEFLGNLLLLIVGGNDTTRNSISGGVLALNQNPDAYLKLNNDPGLITSMVPEIIRWQTPLTHMRRTALQDWEIGGKKIRKGDKVVMWYLSGNRDETVIDRADEFIIDRKNPRHHLSFGYGIHRCMGNRLAELQLRIIWEEIHKRFAKIEVTGEPERLFSNLVRGITKLPVRLHAR

SEQ ID NO: 73 - protein, 425 aa, Sphingopyxis macrogoltabida
MATRSMQSGPDREEPDRPIAEIPLAEIDVSRPSLFQSDKVGAFFERLRREDPVHYCSESAFGPYWSITRYNDIMAVDTNHKLFSSEAKLGGIAIQDMHNDATNLELEMFIAMDQPKHDAQRKAVTPAVAPSNLLLLEPVIRERAGAILDSLPVGEEIDWVKSVSVELTTMTLATLFDFPWDERAKLTRWSDVTTAIPGSGIVESNEQRRQELIECAMYFKGLWDQRIDRSEGSDLITMMANSPATREMPFLEFLGNLLLLIVGGNDTTRNSISGGVIALNQNPDQYEKLRQHPSLIGSMVPEIIRWQTPLTHMRRTALADSEIGGKRIAKGDKVVMWYLSGNRDETVIERPEEFIIDRKNPRQHLSFGYGIHRCMGNRLAELQLRIIWEEIHKRFRLVEMVGEPERLLSNLVRGITRLPVKLHAH

SEQ ID NO: 74 - protein, 429 aa, Sphingopyxis macrogoltabida
MATVIRETPADLHPLDLSRADLWREDQWQEPMRQLRAESPIYYCEDSKFGPYWSVTTYKPIQHIEALPKIFSSSWEYGGITVAGDGIEHLKEGEIPMPMFIAMDPPQHTAQRRTVAPAFGPSEIERMRADTQARTAALIDTLPVGEAFDWVERLSIELTTDMLAILFDFPWENRHNLTRWSDALGDIESFNTLEERQQRLATAFEMGAAFKELWDHKAKNPGKHDLISIMLQSDAMNHMSHEEFMGNLILLIVGGNDTTRNSMSAYAYGLHCFPEERAKLEANHDPDLAVNAMHEIIRWQTPLAHMRRTALEDTELFGHQIRARDKIALWYASANRDESIFPDGDRIIVDRENARRHLAFGYGIHRCVGARVAELQLTTLISEMQKRRLRVNVLAEPERVNASFVHVSPHAGRTRALLTAVTAGPISAR

SEQ ID NO: 75 - protein, 416 aa, Sphingopyxis macrogoltabida
  misc_feature (118)..(118): Xaa can be any naturally occurring amino acid
  misc_feature (315)..(315): Xaa can be any naturally occurring amino acid
  misc_feature (318)..(319): Xaa can be any naturally occurring amino acid
MASTATLVRTASPIAPIDVSLPELYAEDRWQEPFRTLRAQAPIQYVPDSKFGPYWSVTTYKPIVYIEALPKLFSSSWQYGGISIAFDSDKLLEHEVRQPMFIAMDPPQHTAQRRTVAXSFGPSEVAAMKAEVQLRTGALLDSLPVGDPFDWVQKVSIELTTGMLARLFDFPWEERHNLTHWSDIGGDVELIRSPEGLVERNTKLLQMGMAFAALWQEKAQNPGKDLISVMLKSDAMNHMSNEEFIGNLVLLIVGGNDTTRNSMSSYAYGLAQFPEERAKLEANPALIPNAVQELIRWQTPLAHMRRTVEEDTEIXGQXXKKGDKVVLWYLSANRDETVFKDADRIIVGRENARRHLSFGYGIHRCVGARVAELQLVTLLEEMAKRRLRANVLAEPVRVPACFVHGYKSLQVELSHY

SEQ ID NO: 76 - protein, 470 aa, Alcanivorax borkumensis
MSTSSSTSNDIQAKVINATSKVVPMHLQIKALKNLMKVKRKTIGTSRPQVHFVETDLPDVNDLAIEDIDTSNPFLYRQGKANAYFKRLRDEAPVHYQKNSAFGPFWSVTRYEDIVFVDKSHDLFSAEPQIILGDPPEGLSVEMFIAMDPPKHDVQRRAVQGVVAPKNLKEMEGLIRKRTGDVLDSLPLDTPFNWVPVVSKELTGRMLASLLDFPYDEREKLVGWSDRLSGASSATGGEFTNEDVFFDDAADMAWAFSKLWRDKEARQKAGEEPGFDLISMLQSNEDTKDLINRPLEFIGNLALLIVGGNDTTRNSMSGGVLALNQFPEQFEKLKANPKLIPNMVSEIIRWQTPLAYMRRVAKQDVELNGETIKKGDRVLMWYASGNQDERKFENPEQFIIDRKDTRNHVSFGYGVHRCMGNRLAELQLRILWEELLPRFENIEVIGEPERVQSNFVRGYSKMMVKLTAKK

SEQ ID NO: 77 - protein, 497 aa, Acinetobacter sp. EB104
MNSVAEIFEKITQTVTSTAADVATTVTDKVKSNEQFQTGKQFLHGQVTRFVPLHTQVRGIQWMQKAKFRVFNVQEFPAFIEQPIPEVATLALAEIDVSNPFLYKQKKWQSYFKRLRDEAPVHYQANSPFGAFWSVTRYDDIVYVDKNHEIFSAEPVIAIGNTPPGLDAEMFIAMDPPKHDVQRQAVQDVVAPKNLKELEGLIRLRVQGVLDQLPTDQPFDWVQNVSIELTARMLATLFDFPYEKRHKLVEWSDLMAGTAEATGGTVTNLDEIFDAAVDAAKHFAELWHRKAAQKSAGAEMGYDLISLMQSNEATKDLIYRPMEFMGNLVLLIVGGNDTTRNSMTGGVYALNLFPNEFVKLKNNPSLIPNMVSEIIRWQTPLAYMRRIAKQDVELNGQTIKKGDKVVMWYVSGNRDERVIERPDELIIDRKGARNHLSFGFGVHRCMGNRLAEMQLRILWEELLQRFENIEVLGEPEIVQSNFVRGYAKMMVKLTAKA

SEQ ID NO: 78 - protein, 497 aa, Acinetobacter sp. OC4
MNSVAEIFEKITQTVTSTAADVATTVTDKVKSNEQFQTGKQFLHGQVTRFVPLHTQVRGIQWMQKAKFRVFNVQEFPAFIEQPIPEVATLALAEIDVSNPFLYKQKKWQSYFKRLRDEAPVHYQANSPFGAFWSVTRYDDIVYVDKNHEIFSAEPVIAIGNTPPGLGAEMFIAMDPPKHDVQRQAVQDVVAPKNLKELEGLIRLRVQEVLDQLPTDQPFDWVQNVSIELTARMLATLFDFPYEKRHKLVEWSDLMAGTAEATGGTVTNLDEIFDAAVDAAKHFAELWHRKAAQKSAGAEMGYDLISLMQSNEATKDLIYRPMEFMGNLVLLIVGGNDTTRNSMTGGVYALNLFPNEFVKLKNNPSLIPNMVSEIIRWQTPLAYMRRIAKQDVELNGQTIKKGDKVVMWYVSGNRDERVIERPDELIIDRKGARNHLSFGFGVHRCMGNRLAEMQLRILWEELLQRFENIEVLGEPEIVQSNFVRGYAKMMVKLTAKA

SEQ ID NO: 79 - protein, 488 aa, Artemisia annua
MALSLTTSIALATILLFVYKFATRSKSTKKSLPEPWRLPIIGHMHHLIGTTPHRGVRDLARKYGSLMHLQLGEVPTIVVSSPKWAKEILTTYDITFANRPETLTGEIVLYHNTDVVLAPYGEYWRQLRKICTLELLSVKKVKSFQSLREEECWNLVQEIKASGSGRPVNLSENIFKLIATILSRAAFGKGIKDQKELTEIVKEILRQTGGFDVADIFPSKKFLHHLSGKRARLTSLRKKIDNLIDNLVAEHTVNTSSKTNETLLDVLLRLKDSAEFPLTSDNIKAIILDMFGAGTDTSSSTIEWAISELIKCPKAMEKVQAELRKALNGKEKIHEEDIQELSYLNMVIKETLRLHPPLPLVLPRECRQPVNLAGYNIPNKTKLIVNVFAINRDPEYWKDAEAFIPERFENSSATVMGAEYEYLPFGAGRRMCPGAALGLANVQLPLANILYHFNWKLPNGVSYDQIDMTESSGATMQRKTELLLVPSF

SEQ ID NO: 80 - protein, 496 aa, Cichorium intybus
MEISIPTTLGLAVIIFIIFKLLTRTTSKKNLLPEPWRLPIIGHMHHLIGTMPHRGVMELARKHGSLMHLQLGEVSTIVVSSPRWAKEVLTTYDITFANRPETLTGEIVAYHNTDIVLAPYGEYWRQLRKLCTLELLSNKKVKSFQSLREEECWNLVKDIRSTGQGSPINLSENIFKMIATILSRAAFGKGIKDQMKFTELVKEILRLTGGFDVADIFPSKKLLHHLSGKRAKLTNIHNKLDNLINNIIAEHPGNRTSSSQETLLDVLLRLKESAEFPLTADNVKAVILDMFGAGTDTSSATIEWAISELIRCPRAMEKVQTELRQALNGKERIQEEDLQELNYLKLVIKETLRLHPPLPLVMPRECREPCVLGGYDIPSKTKLIVNVFAINRDPEYWKDAETFMPERFENSPITVMGSEYEYLPFGAGRRMCPGAALGLANVELPLAHILYYFNWKLPNGKTFEDLDMTESFGATVQRKTELLLVPTDFQTLTAST

SEQ ID NO: 81 - protein, 497 aa, Taxus cuspidata
MDSFIFLRSIGTKFGQLESSPAILSLTLAPILAIILLLLFRYNHRSSVKLPPGKLGFPLIGETIQLLRTLRSETPQKFFDDRLKKFGPVYMTSLIGHPTVVLCGPAGNKLVLSNEDKLVEMEGPKSFMKLIGEDSIVAKRGEDHRILRTALARFLGAQALQNYLGRMSSEIGHHFNEKWKGKDEVKVLPLVRGLIFSIASTLFFDVNDGHQQKQLHHLLETILVGSLSVPLDFPGTRYRKGLQARLKLDEILSSLIKRRRRDLRSGIASDDQDLLSVLLTFRDEKGNSLTDQGILDNFSAMFHASYDTTVAPMALIFKLLYSNPEYHEKVFQEQLEIIGNKKEGEEISWKDLKSMKYTWQAVQESLRMYPPVFGIFRKAITDIHYDGYTIPKGWRVLCSPYTTHLREEYFPEPEEFRPSRFEDEGRHVTPYTYVPFGGGLRTCPGWEFSKIEILLFVHHFVKNFSSYIPVDPNEKVLSDPLPPLPANGFSIKLFPRS

SEQ ID NO: 82 - protein, 485 aa, Taxus cuspidata
MDALKQLEVSPSILFVTLAVMAGIILFFRSKRHSSVKLPPGNLGFPLVGETLQFVRSLGSSTPQQFIEERMSKFGDVFKTSIIGHPTVVLCGPAGNRLVLSNENKLVQMSWPSSMMKLIGEDCLGGKTGEQHRIVRAALTRFLGPQALQNHFAKMSSGIQRHINEKWKGKDEATVLPLVKDLVFSVASRLFFGITEEHLQEQLHNLLEVILVGSFSVPLNIPGFSYHKAIQARATLADIMTHLIEKRRNELRAGTASENQDLLSVLLTFTDERGNSLADKEILDNFSMLLHGSYDSTNSPLTMLIKVLASHPESYEKVAQEQFGILSTKMEGEEIAWKDLKEMKYSWQVVQETLRMYPPIFGTFRKAITDIHYNGYTIPKGWKLLWTTYSTQTKEEYFKDADQFKPSRFEEEGKHVTPYTYLPFGGGMRVCPGWEFAKMETLLFLHHFVKAFSGLKAIDPNEKLSGKPLPPLPVNGLPIKLYSRS

SEQ ID NO: 83 - protein, 500 aa, Taxus cuspidata
MDALSLVNSTVAKFNEVTQLQASPAILSTALTAIAGIIVLLVITSKRRSSLKLPPGKLGLPFIGETLEFVKALRSDTLRQFVEEREGKFGRVFKTSLLGKPTVILCGPAGNRLVLSNEEKLLHVSWSAQIARILGLNSVAVKRGDDHRVLRVALAGFLGSAGLQLYIGKMSALIRNHINEKWKGKDEVNVLSLVRDLVMDNSAILFFNIYDKERKQQLHEILKIILASHFGIPLNIPGFLYRKALKGSLKRKKILSALLEKRKDELRSRLASSNQDLLSVLLSFRDERGKPLSDEAVLDNCFAMLDASYDTTTSQMTLILKMLSSNPECFEKVVQEQLEIASNKKEGEEITMKDIKAMKYTWQVLQESLRMLSPVFGTLRKTMNDINHDGYTIPKGWQVVWTTYSTHQKDIYFKQPDKFMPSRFEEEDGHLDAYTFVPFGGGRRTCPGWEYAKVEILLFLHHFVKAFSGYTPTDPHERICGYPVPLVPVKGFPIKLIARS

SEQ ID NO: 84 - protein, 502 aa, Taxus wallichiana var. chinensis
MDALYKSTVAKFNEVTQLDCSTESFSIALSSIAGILLLLLLFRSKRHSSLKLPPGKLGIPFIGESFIFLRALRSNSLEQFFDERVKKFGLVFKTSLIGHPTVVLCGPAGNRLILSNEEKLVQMSWPAQFMKLMGENSVATRRGEDHIVMRSALAGFFGPGALQSYIGKMNTEIQNHINEKWKGKDEVNVLPLVRELVFNISAILFFNIYDKQEQDRLHKLLETILVGSFALPIDLPGFGFHRALQGRATLNKIMLSLIKKRKEDLQSGSATATQDLLSVLLTFRDDKGTPLTNDEILDNFSSLLHASYDTTTSPMALIFKLLSSNPECYQKVVQEQLEILSNKEEGEEITWKDLKAMKYTWQVAQETLRMFPPVFGTFRKAITDIQYDGYTIPKGWKLLWTTYSTHPKDLYFSEPEKFMPSRFDQEGKHVAPYTFLPFGGGQRSCVGWEFSKMEILLFVHHFVKTFSSYTPVDPDEKISGDPLPPLPSKGFSIKLFPETIVN

SEQ ID NO: 85 - protein, 504 aa, Nicotiana tabacum
MQFFSLVSIFLFLSFLFLLRKWKNSNSQSKKLPPGPWKIPILGSMLHMIGGEPHHVLRDLAKKYGPLMHLQLGEISAVVVTSRDMAKEVLKTHDVVFASRPKIVAMDIICYNQSDIAFSPYGDHWRQMRKICVMELLNAKNVRSFSSIRRDEVVRLIDSIRSDSSSGELVNFTQRIIWFASSMTCRSAFGQVLKGQDIFAKKIREVIGLAEGFDVVDIFPTYKFLHVLSGMKRKLLNAHLKVDAIVEDVINEHKKNLAAGKSNGALGGEDLIDVLLRLMNDTSLQFPITNDNIKAVIVDMFAAGTETSSTTTVWAMAEMMKNPSVFTKAQAEVREAFRDKVSFDENDVEELKYLKLVIKETLRLHPPSPLLVPRECREDTDINGYTIPAKTKVMVNVWALGRDPKYWDDAESFKPERFEQCSVDFFGNNFEFLPFGGGRRICPGMSFGLANLYLPLAQLLYHFDWKLPTGIMPRDLDLTELSGITIARKGGLYLNATPYQPSRE

SEQ ID NO: 86 - protein, 488 aa, Cichorium intybus
MELSLTTSIALATIVLILYKLATRPKSNKKRLPEASRLPIIGHMHHLIGTMPHRGVMELARKHGSLMHLQLGEVSTIVVSSPKWAKEILTTYDITFANRPETLTGEIIAYHNTDIVLAPYGEYWRQLRKLCTLELLSVKKVKSFQSIREEECWNLVKEVKESGSGKPISLSESIFKMIATILSRAAFGKGIKDQREFTEIVKEILRQTGGFDVADIFPSKKFLHHLSGKRARLTSIHKKLDTLINNIVAEHHVSTSSKANETLLDVLLRLKDSAEFPLTADNVKAIILDMFGAGTDTSSATVEWAISELIRCPRAMEKVQAELRQALNGKEQIHEEDIQDLPYLNLVIRETLRLHPPLPLVMPRECREPVNLAGYEIANKTKLIVNVFAINRDPEYWKDAEAFIPERFENNPNNIMGADYEYLPFGAGRRMCPGAALGLANVQLPLANILYHFNWKLPNGASHDQLDMTESFGATVQRKTELILVPSF

SEQ ID NO: 87 - protein, 494 aa, Cichorium intybus
MEPLTIVSLVVASLFLFAFWALSPKTSKNLPPGPPKLPIIGNIHQLKSPTPHRVLRNLARKYGPIMHLQLGQVSTVVVSTPRLAREIMKTNDISFADRPTTTTSQIFFYKAQDIGWAPYGEYWRQMKKICTLELLSAKKVRSFSSIREEELSRISKVLESQAGTPINFTEMTVEMVNNVICKATLGDSCKDQATLIEVLYDVLKTLSAFNLASYYPGLQFLNVILGKKAKWLKMQKQLDDILEDVLKEHRSKGSNKSDQEDLVDVLLRVKDTGGLDFTVTDEHVKAVVLDMLTAGTDTSSATLEWAMTELMRNPHMMKRAQDEVRSVVKGNTITETDLQSLHYLKLIVKETLRLHAPTPLLVPRECRQDCNVDGYDIPAKTKILVNAWACGTDPDSWKDPESFIPERFENCPINYMGADFEFIPFGAGRRICPGLTFGLSMVEYPLANFLYHFDWKLPNGLKPHELDITEITGISTSLKHQLKIVPMIPKSIAK

SEQ ID NO: 88 - protein, 518 aa, Xanthophyllomyces dendrorhous
SIAFFSLYLAPRRSSLYNLQGPDHTNYFTGNFLDILSARTGEEHAKYREKYGSTLRFAGIAGAPVLNSTDPKVFNHVMKEAYDYPKPGMAARVLRIATGDGVVTAEGEAHKRHRRIMIPSLSAQAVKSMVPIFLEEGMELVDKMMEDAAEKDMAVGESAGEKKATRLETEGVDVKDWVGRATLDVMALAGFDYKSDSLQNKTNELYVAFVGLTDGFAPTLDSFKAIMWDFVPYFRTMKRRHEIPLTQGLAVSRRVGIELMEQKKQAVLGSASDQAVDKKDVQGRDILSLLVRANIAANLPESQKLSDEEALAQISNLLFAGYETSSTVLTWMFHRLSEDKAVQDKLREEICQIDTDMPTLDELNALPYLEAFVKESLRLDPPSPYANRECLKDEDFIPLAEPVIGRDGSVINEVRITKGTMVVLPLFNVNRSKFIYGEDAEEFRPERWLEDVTDSLNSIEAPYGHQASFISGPRACFGWRFAVAEMKAFLFVTLRRVQFEPIISHPEYEHITLIISRP

SEQ ID NO: 89 - protein, 468 aa, Nostoc sp. PCC7120
MKYQIQRPNPLKTHPFLQKLQWIADPVEYMKKASLQHPDMFTAEVIGFGDTVVFVSHPQGIQTLFANDRKKLVAVGEANRILYPLVGNNSMFLLEGVKHKQRRQLLMPSFHGERMREYGHLIRNITENLFSQLQQDVTFSALTAMREISMQVILQAVFGFYEGERCQQFKHLLPIFLSELFQSPLASSILFFPSLQKDLGNLTPWGRFVRQREKIDKLLYAEIAERRQEINSDRIDILSLLISARDETGDSMSDKELRDELITLMISGHETTGTAMAWSLYWILQTPEVFQRLIQELDSLGDSPDPMSIFRLPYLTAVCNETLRINPVAMLTLPRVVKEPIELLGNRLETSTTVVGCIYLTHHREDLYPESKLFKPERFLKREFSQYEFMPFGGGVRGCIGQALAMFEMKIVLATVLSRYQLALADRKPERPQRQGFTLTPTNGVKMLITGQHKRQNYSMAASTTFNA

SEQ ID NO: 90 - protein, 502 aa, Oryza sativa
MMEINSEATVTLVSVVTLPILLALLTRKSSSKKRRPPGPWNLPLVGGLLHLLRSQPQVALRDLAGKYGPVMFLRTGQVDTVVISSPAAAQEVLRDKDVTFASRPSLLVSEIFCYGNLDIGFAPYGAYWRMLRKLCTVELLSTKMVRQLAPIRDGETLALVRNIEAAAGGKKPFTLATLLISCTNTFTAKAAFGQACGGELQEQFLTALDEALKFSNGFCFGDLFPSLRFIDAMTGLRSRLERLRLQLDTVFDKIVAQCESNPGDSLVNVLLRIKDQGELDFPFSSTHVKAIILDMFTGGTETTSSTTEWLMSELMRNPEVMAKVQAEVRGVFDNKSPQDHEGLLENLSYMKLVIKETLRLNPVLPLLLPHLCRETCEIGGYEIVEGTRVLINSWAMARSPEYWDDAEKFIPERFEDGTADFKGSRFEYLPFGTGRRRCPGDIFAMATLELIVARLLYYFDWSLPDGMQPGDIDMELVVGATARRKNHLQLVASPYKPISMQS

SEQ ID NO: 91 - protein, 493 aa, Helianthus annuus
MSLDFQVFLFSSLPLLLAILLLKLYFSSSKSHINLPPSPPKLPLIGNLHQLGSGTHRVLQSMAQTYGPLMLLHFGTVPVVVASSVDAARDIMKTHDIIFSNRPFLNIANRLFYNSKDIAFAKYGEYWRQVKSISVLHLLSNKRVKSYRQVREDEVAHMIKKIQGANESVVNLSELLISLTNNVISRVALGRTYEGMGVNYKNIPVRIGAILGRFSIGSYIPWLAWVDRLTGLHREADQLAKEIDEFYEGVIEEHVNKKVVDVEGQDLVDILLELQRDNSTSFLLERYTVKAIIMDVFGAGTDTIFASLEWAISELLRNPHTMKELQQEARKIGQGRLMIPENDIEKMPYLKAVLKEALRLHVPAPLLVPRESTKEVKLLGYDIPAHTQVMINAWAIARDPSIWEEPEEFRPERFLNIRTDYKGFDFELIPFGAGRRMCPGISFAETIIELALANLAYKFEFTLPSEDGLDMTESDGITVHRKFPILVIPTPCE

SEQ ID NO: 92 - protein, 496 aa, Cichorium intybus; identical to SEQ ID NO: 80

SEQ ID NO: 93 - protein, 408 aa, Sorangium cellulosum
METETAPSPSPEQIDLSAPSVIADPYPAYRALRGRSPVLYARVPAGGAAGLGEPIRAYALLRHAEVLAALRDPQTFSSNVTDKIRVLPRITLLHDDPPRHTHLRRLVSRSFTPRRIAELEPWIGRLAASLLEATGDGPSDLMGAYAMPLPMMVIATLLGIPAERYVQFRSWSESVMSYSGIPAEERASRGKAMVDFFAAELEARRRAPSGDLISALVEAEIDGARLDTPEAVGFCVGLLVAGNDTTTNLIGNMAHLLSERPELYRRAQQDRSLVGPIIEETLRHSSPVQRLLRVTTRPVDVSGVMIPAGHLVDVVFGAANRDPAVFEEPDAFRLDRPPAEHLAFGQGTHFCIGAALARMEARIALNALLDCYESITPGEAPPLRQTRAIMPLGFESLPLVLRRSRATA

SEQ ID NO: 94 - protein, 497 aa, Diploptera punctata
AVLLLTSLAIVVVYLCRRLNFWVKLRSVPGPPALPFLGNSLILRGTQEEFFRLLSKCATKYGNIFRLWVGQRPFVFLYSAEAIQPILNSTVYIDKSYEYSFLFPWLGTGLLTSTGNKWHTRRKLLTQSFHSKVLEDFLEPIYQHSLFLCNRLELELDKPHFKVTPYAKLCALDIICDTAMGSTINAQENSQSEYVTAVDSLSEIVQRRFITPWLKPDFLFKMTKLGKKQEQCLKIVHNFTRKVINERKEDKLRQNNLEVEISQQNGIKKKHRLALLDLLLELSENGKVLTDEDICEEVDTFMFAGHDTIASGVSWILYVLGHHLDSQEKIVEEFKNVMEEDNTEWPTMKHLNKLCYLERCIKEAMRLYPVVPLIARNLTQPIKIMDYMLPEGVTILINTYLLHRDSRFFPNPDIFEPDRFLTSNCEARNPFAYVPFSAGPRNCIGQKFAMMELKIILSTVLQRFIVKSVDKEERLKLVGELVLLNRDGIRLTITART

SEQ ID NO: 95 - protein, 497 aa, Diploptera punctata
MLSSLKDFFVLLLPFFIGIAFIYKLWNFTSKKNLPPSPRRLPIIGNLHQLSKFPQRSLRTLSEKYGPVMLLHFGSKPVLVISSAEAAKEVMKINDVSFADRPKWYAAGRVLYEFKDMTFSPYGEYWRQARSICVLQLLSNKRVQSFKGIREEEIRAMLEKINQASNNSSIINGDEIFSTLTNDIIGRSAFGRKFSEEESGSKLRKVLQDLPPLLGSFNVGDFIPWLSWVNYLNGFEKKLNQVSKDCDQYLEQVIDDTRKRDEENGANNNGGNHGNFVSVLLHLQKEDVKGFPSEKGFLKAIILDMIVGGTDTTHLLLHWVITELLKNKHVMTKLQKEVREIVGRKWEITDEDKEKMKYLHAVIKEALRLHPSLPLLVPRVAREDINLMGYRVAKGTEVIINAWAIARDPSYWDEAEEFKPERFLSNNFDFKGLNFEYIPFGSGRRSCPGSSFAIPIVEHTVAHLMHKFNIELPNGVSAEDFDPTDAVGLVSHDQNPL

SEQ ID NO: 96 - protein, 496 aa, Glycine max
MDLQLLYFTSIFSIFIFMFMTHKIVTKKSNSTPSLPPGPWKLPIIGNMHNLVGSPLPHHRLRDLSAKYGSLMHLKLGEVSTIVVSSPEYAKEVMKTHDHIFASRPYVLAAEIMDYDFKGVAFTPYGDYWRQLRKIFALELLSSKRVQSFQPIREEVLTSFIKRMATIEGSQVNVTKEVISTVFTITARTALGSKSRHHQKLISVVTEAAKISGGFDLGDLYPSVKFLQHMSGLKPKLEKLHQQADQIMQNIINEHREAKSSATGDQGEEEVLLDVLLKKEFGLSDESIKAVIWDIFGGGSDTSSATITWAMAEMIKNPRTMEKVQTEVRRVFDKEGRPNGSGTENLKYLKSVVSETLRLHPPAPLLLPRECGQACEINGYHIPAKSRVIVNAWAIGRDPRLWTEAERFYPERFIERSIEYKSNSFEFIPFGAGRRMCPGLTFGLSNVEYVLAMLMYHFDWKLPKGTKNEDLGMTEIFGITVARKDDLYLIPKTVHN

SEQ ID NO: 97 - protein, 506 aa, Artificial Sequence
  Synthesized sequence
MEFYYFLYLAFLLFCFILSKTTKKFGQNSQYSNHDELPPGPPQIPILGNAHQLSGGHTHHILRDLAKKYGPLMHLKIGEVSTIVASSPQIAEEIFRTHDILFADRPSNLESFKIVSYDFSDMVVSPYGNYWRQLRKISMMELLSQKSVQSFRSIREEEVLNFIKSIGSKEGTRINLSKEISLLIYGITTRAAFGEKNKNTEEFIRLLDQLTKAVAEPNIADMFPSLKFLQLISTSKYKIEKIHKQFDVIVETILKGHKEKINKPLSQENGEKKEDLVDVLLNIQRRNDFEAPLGDKNIKAIIFNIFSAGTETSSTTVDWAMCEMIKNPTVMKKAQEEVRKVFNEEGNVDETKLHQLKYLQAVIKETLRLHPPVPLLLPRECREQCKIKGYTIPSKSRVIVNAWAIGRDPNYWIEPEKFNPDRFLESKVDFKGNSFEYLPFGGGRRICPGITFALANIELPLAQLLFHFDWQSNTEKLNMKESRGVTVRREDDLYLTPVNFSSSSPA

SEQ ID NO: 98 - protein, 531 aa, Sorghum bicolor
MATTATPQLLGGSVPQQWQTCLLVLLPVLLVSYYLLTSRSRNRSRSGKLGGAPRLPPGPAQLPILGNLHLLGPLPHKNLRELARRYGPVMQLRLGTVPTVVVSSAEAAREVLKVHDVDCCSRPASPGPKRLSYDLKNVGFAPYGEYWREMRKLFALELLSMRRVKAACYAREQEMDRLVADLDRAAASKASIVLNDHVFALTDGIIGTVAFGNIYASKQFAHKERFQHVLDDAMDMMASFSAEDFFPNAAGRLADRLSGFLARRERIFNELDVFFEKVIDQHMDPARPVPDNGGDLVDVLINLCKEHDGTLRFTRDHVKAIVLDTFIGAIDTSSVTILWAMSELMRKPQVLRKAQAEVRAAVGDDKPRVNSEDAAKIPYLKMVVKETLRLHPPATLLVPRETMRDTTICGYDVPANTRVFVNAWAIGRDPASWPAPDEFNPDRFVGSDVDYYGSHFELIPFGAGRRICPGLTMGETNVTFTLANLLYCYDWALPGAMKPEDVSMEETGALTFHRKTPLVVVPTKYKNRRAA

SEQ ID NO: 99 - protein, 461 aa, Streptomyces coelicolor
MTVESVNPETRAPAAPGAPELREPPVAGGGVPLLGHGWRLARDPLAFMSQLRDHGDVVRIKLGPKTVYAVTNPELTGALALNPDYHIAGPLWESLEGLLGKEGVATANGPLHRRQRRTIQPAFRLDAIPAYGPIMEEEAHALTERWQPGKTVDATSESFRVAVRVAARCLLRGQYMDERAERLCVALATVFRGMYRRMVVPLGPLYRLPLPANRRFNDALADLHLLVDEIIAERRASGQKPDDLLTALLEAKDDNGDPIGEQEIHDQVVAILTPGSETIASTIMWLLQALADHPEHADRIRDEVEAVTGGRPVAFEDVRKLRHTGNVIVEAMRLRPAVWVLTRRAVAESELGGYRIPAGADIIYSPYAIQRDPKSYDDNLEFDPDRWLPERAANVPKYAMKPFSAGKRKCPSDHFSMAQLTLITAALATKYRFEQVAGSNDAVRVGITLRPHDLLVRPVAR

SEQ ID NO: 100 - protein, 495 aa, Swertia mussotii
MDFDFLTIAIGFLFTITLYQALNFFSRKSKNLPPGPSPLPLIGNLHLLGDQPHKSLAKLAKKHGPIMGLQLGQVTTIVVTSSGMAKEVLQKQDLAFSSRSIPNAIHAHDQYKYSVIWLPVASRWRGLRKALNSNMFSGNRLDANQHLRSRKVQELIAYCRKSSQTGDAIDVGRAAFRTSLNLLSNTMFSKDLTDPYSDSAKEFKDLVWNVMVEAGKPNLVDYFPLLDKVDPQGIRKRMTIHFGKILELFGGLIDERLQQKKAKGVNDDVLDVLLTTSEESPEEIDRTHIQRMCLDLFVAGTDTTSSTLEWAMSEMLKNPEKMKAAQAELAQVIGKGKAVEEADLARLPYLRCAIKETLRIHPPVPLLIPRRTEQEVEVCGYTVPKNSQVLVNVWAISRDDAIWKDPLSFKPERFLESELEMRGKDFELIPFGAGRRICPGLPLAVRMVPVMLGSLLNSFDWKLEGGIAPKDLDMEEKFGITLQKAHPLRAVATPL

SEQ ID NO: 101 - protein, 487 aa, Berberis stolonifera
MDYIVGFVSISLVALLYFLLFKPKHTNLPPSPPAWPIVGHLPDLISKNSPPFLDYMSNIAQKYGPLIHLKFGLHSSIFASTKEAAMEVLQTNDKVLSGRQPLPCFRIKPHIDYSILWSDSNSYWKKGRKILHTEIFSQKMLQAQEKNRERVAGNLVNFIMTKVGDVVELRSWLFGCALNVLGHVVFSKDVFEYSDQSDEVGMDKLIHGMLMTGGDFDVASYFPVLARFDLHGLKRKMDEQFKLLIKIWEGEVLARRANRNPEPKDMLDVLIANDFNEHQINAMFMETFGPGSDTNSNIIEWALAQLIKNPDKLAKLREELDRVVGRSSTVKESHFSELPYLQACVKETMRLYPPISIMIPHRCMETCQVMGYTIPKGMDVHVNAHAIGRDPKDWKDPLKFQPERFLDSDIEYNGKQFQFIPFGSGRRICPGRPLAVRIIPLVLASLVHAFGWELPDGVPNEKLDMEELFTLSLCMAKPLRVIPKVRI

SEQ ID NO: 102 - protein, 499 aa, Glycyrrhiza echinata
MEILSLLSYSVFYLALFFIFNIVIRARKFKNLPPGPPSLPIIGNLHHLKRPLHRTFKGLSEKYGHVFSLWFGSRLVVVVSSASEFQQCFTKNDVVLANRPRFLSGKYIFYNYTTLGSTSYGEHWRNLRRITALDVLSNHRINSFSGIRRDETQRLITRLADDSSTNFAEMELSSRLYDMTFNNIMRMISGKRYYGEDCDTSDLQEASQFRDMVSELLQLSGANNKTDFMPLLRFLDFENLEKRLKDISGKTDAFLRGLIEEHRTKKERANTMIDHLLNLQDSQPEYYTDQIIKGLALAMLLAGTDSSAVTLEWSMSNLLNHPEVLKKVKDELDTHVGQDRLVDESDLPKLTYLKNVINETLRLYTPAPLLLPHSTSDECNIGGYKVPQDTIVLINAWAIHRDPELWTEATTFKPERFEKKGELEKLIAFGMGRRACPGEGLAIRAISMTLALLIQCFDWKLINGDKIDLAERDGFTLTKLVPLKAMCKSRPVINKVFKQ

SEQ ID NO: 103 - protein, 519 aa, Zea mays
MLGVGMAAAVLLGAVALLLADAAARRAHWWYREAAEAVLVGAVALVVVDAAARRAHGWYREAALGAARRARLPPGEMGWPLVGGMWAFLRAFKSGKPDAFIASFVRRFGRTGVYRSFMFSSPTVLVTTAEGCKQVLMDDDAFVTGWPKATVALVGPRSFVAMPYDEHRRIRKLTAAPINGFDALTGYLPFIDRTVTSSLRAWADHGGSVEFLTELRRMTFKIIVQIFLGGADQATTRALERSYTELNYGMRAMAINLPGFAYRGALRARRRLVAVLQGVLDERRAARAKGVSGGGVDMMDRLIEAQDERGRHLDDDEIIDVLVMYLNAGHESSGHITMWATVFLQENPDMFARAKAEQEAIMRSIPSSQRGLTLRDFRKMEYLSQVIDETLRLVNISFVSFRQATRDVFVNGYLIPKGWKVQLWYRSVHMDPQVYPDPTKFDPSRWEGHSPRAGTFLAFGLGARLCPGNDLAKLEISVFLHHFLLGYKLARTNPRCRVRYLPHPRPVDNCLAKITRVGS

SEQ ID NO: 104 - protein, 509 aa, Nicotiana tabacum
MEGTNLTTYAAVFLGTLFLLLLSKFLRQRKLNLPPGPKPWPIIGNLNLIGNLPHRSIHELSLKYGPIMQLQFGTFPVVVGSSVEMAKVFLKSMDINFVGRPKTAAGKYTTYNYSDITWSPYGPYWRQARRMCLMELFSTKRLDSYEYIRAEELHSLLHNLNKISGKPIVLKDYLTTLSLNVISRMVLGKRYLDESENSIVTPEEFKKMLDELFLLNGVLNIGDSIPWIDFMDLQGYVKRMKFVSKKFDKFLEHVIDEHNVRRNGVENYIAKDMVDVLLQLADDPTLEVKLERHGVKAFTQDMLAGGTESSAVTVEWAISELLKKPEIFKKATEELDRVIGQNRWVQEKDIPNLPYIEAIVKETMRLHPVAPMLVPRECREDCKVAGYDVKKGTRVLVSVWTIGRDPTLWDEPEAFKPERFHEKSIDVKGHDFELLPFGAGRRMCPGYNLGLKVIQASLANLIHGFNWSLPDNMTPEDLDMDEIFGLSTPKKFPLATVIEPRLSPKLYSV

SEQ ID NO: 105 - protein, 501 aa, Catharanthus roseus
MALASIEKVATGLICFILLIFSLKRIGHPRDWALVGILSVWFPSLGHIYEKLAKSLAKNDKTFVLKGSFLSKQDVIFTCDPANMHHVMSTNFSNYPKGPENRNVFDVYGEMLFTADHEKWKSHRKVTNAYFHDQRFNGFSQKVNKEVIEKELFPFLDHAAEEALVFDLQDVFQRLMLDSSSILTTGQNHRSLRVGLPYDETLEAINIANYQIFVRHILPAKIWKFQKWLGIMGEKKIKKAWRILDDISVEYMNRRKKEISSTISSQEDMDVVKFSEEDHVVLKSVDASDNLLRDTVKGILLAGTDTTATVLSWFFWLILKNPRVEQKIREEIELYLKQKNGEHGLYTNPEELNELMYLHAAIYETMRLYPAAPFTSRKSIQADVFPTGHQVNPNTTIVMAYYAVGRMKSIWGEDCLEFKPERWLSDKGKLIPVQTNKFLAFGTGPRICPGKELGLNRVKAVAAAIIPKYSFKIMRNKPVMPAACATLYLKDGLIVRVNKII

SEQ ID NO: 106 - protein, 481 aa, Pinus taeda
MADQISLLLVVFTAAVALLHLIYRWWNAQRGQKRTSNEKNQELHLPPGSTGWPLIGETYSYYRSMTSNRPRQFIDDREKRYDSDVFVSHLFGSQAVISSDPQFNKYVLQNEGRFFQAHYPKALKALIGDYGLLSVHGDLQRKLHGIAVNLLRFERLKFDFMEEIQNLVHSTLDRWVDKKEIALQNECHQMVLNLMAKQLLDLSPSKETNEICELFVDYTNAVIAIPIKIPGSTYAKGLKARELLIRKISNMIKERRDHPHIVHKDLLTKLLEEDSISDEIICDFILFLLFAGHETSSRAMTFAIKFLTTCPKALTQMKEEHDAILKAKGGHKKLEWDDYKSMKFTQCVINETLRLGNFGPGVFRETKEDTKVKDCLIPKGWVVFAFLTATHLDEKFHNEALTFNPWRWELDQDVSNNHLFSPFGGGARLCPGSHLARLELALFLHIFITRFRWEALADEHPSYFPLPYLAKGFPMRLYNRE

SEQ ID NO: 107 - protein, 501 aa, Solanum lycopersicum
MASIWGLLSPWIPYFISFIAFLLLLEQISYIKKKRFLPGPTLVFPFLGNVIPLVTNPTKFWDLQSALAKSTSHGFSVNYIIGKFILYIHSTDLSHKVFANVRPDAFHLIGHPFGKKLFGEHNLIYMFGQEHKDLRRRIAPNFTPKALGTYTDIQQRIIIKHFKSWLDEASKSPNTPIPLRLLCRDMNLDTSQAVFVGPYLDGESRKRFNVDYNYFNVGLMKLPVDLPGFAFRNARLAVGRLVDTLSVCVEQSLNKMKNEEEPTCLIDFWMQENLREINEAKINGLQKPFQYSNKELGGYLFDFLFAAQDASTSALLWAIVLLDSHPQVLEKVRSDVARFWSPESEEPLTAEMLREMKYLEAVAREIIRIRAPATMVPHIAGEEFRLTEDYVIPKGTIVFPSVFDSSFQGFPEPEKFEPDRFMEERQEERVYKKNFLAFGAGPHACVGQKYAINHLMLFIAMFTALIDFKRHKTDGCDDISYIPTIAPKDDCKVFLAHRCTR

SEQ ID NO: 108 - protein, 500 aa, Euphorbia lagascae
MEQKNLSFPSILISFLLVLILVVVMRLWKKQNPPPGPWKFPIIGNLPHLLLTSDLGHERFRALAQIYGPVMSLQIGQVSAVVISSAEAAKEVMKTQADAFAQRPIVLDAQIVFYNRKDVLFASYGDHWRQMKKIWILEFLSAKKVQSSRLIREEEMEDAITFLRSKAGSPVNITKIIYGIIISIMIRTSVGNCKQKERLLSVADAVNEAATSFGTADAFPTWKLLHYIIGAESKPRRLHQEIDDILEEILNEHKANKPFEADNLMDVLLNLQKNGNVPVPVTNESIKASVLQMFTAGSETTSKATEWVMAELMKNPTELRKAQEEVRQVFGEMGKVDESRFHDLKFFKLVVKETLRLHPPVVLIPRECRETTRIDGYEIHPNTRIVVNAWAIGRDPNTWSEPGKFNPERFKDCAIDYKGTTFELVPFGAGKRICPGITSAITNLEYVIINLLYHFNWELADGITPQTLDMTEAIGGALRKKIDLKLIPIPYQVSLGSNIS

SEQ ID NO: 109 - protein, 391 aa, Amycolatopsis orientalis
MFEEKNALRGTEIHRRERFDPGPELRALMAEGRMSVMESEESPGGRTGWLATGYEETRQVLGSDKFSAKLLFGGTAAGRIWPGFLNQYDPPEHTRLRRMVASAFTVRRMRDFRPRIEAVVKATLDDIEATGGPVDFVPRFAWPIATTVICDFLGIPRDDQAELSRVLHASRSERSGKRRVAAGNKYWTYMGQVAAKTRRDPGDDMFGAVVREHGDDITDAELLGVAAFVMGASGDQVARFLSAGAWLMVEHPEQFAVLRDDPDSVPDWLNEVARYLTSDEKTTPRIALEDVRIGDQLVKKGDAVTCSLLASNRHRFPDPEDRFDITREKPSHVTFGHGIHHCLGRPLAEMVFRTAIPALAHRFPTLRLAEPDREIKLGPPPFDVEALLLDW

SEQ ID NO: 110 - protein, 398 aa, Amycolatopsis orientalis
MSEDDPRPLHIRRQGLDPADELLAAGALTRVTIGSGADAETHWMATAHAVVRQVMGDHQQFSTRRRWDPRDEIGGKGIFRPRELVGNLMDYDPPEHTRLRRKLTPGFTLRKMQRMAPYIEQIVNDRLDEMERAGSPADLIAFVADKVPGAVLCELVGVPRDDRDMFMKLCHGHLDASLSQKRRAALGDKFSRYLLAMIARERKEPGEGMIGAVVAEYGDDATDEELRGFCVQVMLAGDDNISGMIGLGVLAMLRHPEQIDAFRGDEQSAQRAVDELIRYLTVPYSPTPRIAREDLTLAGQEIKKGDSVICSLPAANRDPALAPDVDRLDVTREPIPHVAFGHGVHHCLGAALARLELRTVFTELWRRFPALRLADPAQDTEFRLTTPAYGLTELMVAW

SEQ ID NO: 111 - protein, 406 aa, Amycolatopsis orientalis
MGHDIDQVAPLLREPANFQLRTNCDPHEDNFGLRAHGPLVRIVGESSTQLGRDFVWQAHGYEVVRRILGDHEHFTTRPQFTQSKSGAHVEAQFVGQISTYDPPEHTRLRKMLTPEFTVRRIRRMEPAIQSLIDDRLDLLEAEGPSADLQGLFADPVGAHALCELLGIPRDDQREFVRRIRRNADLSRGLKARAADSAAFNRYLDNLLARQRADPDDGLLGMIVRDHGDNVTDEELKGLCTALILGGVETVAGMIGFGVLALLDNPGQIELLFESPEKAERVVNELVRYLSPVQAPNPRLAIKDVVIDGQLIKAGDYVLCSILMANRDEALTPDPDVLDANRAAVSDVGFGHGIHYCVGAALARSMLRMAYQTLWRRFPGLRLAVPIEEVKYRSAFVDCPDQVPVTW

SEQ ID NO: 112 - protein, 408 aa, Streptomyces sp. AA4
MTEVAQPSRTQPEQAAFPMKRTCPFAPPPEYDRFRDARAHYVELERSGQRAWVLHRHEDLRAMLNDPRFSSDRFNPGFPVLFKDGLQRRPKLRPSLIGMDAPEHGPARRGVVGEFTVKRMKALQPRIQEIVDEHLDAMLAGDQTADLVSALSLPVPSLVICEQLGVPYADHDFFQKHSSRLLNREISADERGASVEAMQKYLSDLVSAKETAPADDLLSRQIEKKREEGSYDHDDLVSLAFLLLIAGHETTANMISLGTVALLENPDALAAIKEDPGKTLDAVEELLRYFTIAEFATTRVALEDVDIAGVTIKAGEGVLGLSYAANFDPEVFPEPEQFDISRGGRHHVAFGFGAHQCLGQNLARMELQIVFDTLFRRIPTLRLAAPVEALPFKHDSGVFGLYCLPVAW

SEQ ID NO: 113 - protein, 419 aa, Sorangium cellulosum
MTQEQANQSETKPAFDFKPFAPGYAEDPFPAIERLREATPIFYWDEGRSWVLTRYHDVSAVFRDERFAVSREEWESSAEYSSAIPELSDMKKYGLFGLPPEDHARVRKLVNPSFTSRAIDLLRAEIQRTVDQLLDARSGQEEFDVVRDYAEGIPMRAISALLKVPAECDEKFRRFGSATARALGVGLVPRVDEETKTLVASVTEGLALLHGVLDERRRNPLENDVLTMLLQAEADGSRLSTKELVALVGAIIAAGTDTTIYLIAFAVLNLLRSPEALELVKAEPGLMRNALDEVLRFDNILRIGTVRFARQDLEYCGASIKKGEMVFLLIPSALRDGTVFSRPDVFDVRRDTSASLAYGRGPHVCPGVSLARLEAEIAVGTIFRRFPEMKLKETPVFGYHPAFRNIESLNVILKPSKAG

SEQ ID NO: 114 - protein, 416 aa, Streptomyces venezuelae
MRRTQQGTTASPPVLDLGALGQDFAADPYPTYARLRAEGPAHRVRTPEGDEVWLVVGYDRARAVLADPRFSKDWRNSTTPLTEAEAALNHNMLESDPPRHTRLRKLVAREFTMRRVELLRPRVQEIVDGLVDAMLAAPDGRADLMESLAWPLPITVISELLGVPEPDRAAFRVWTDAFVFPDDPAQAQTAMAEMSGYLSRLIDSKRGQDGEDLLSALVRTSDEDGSRLTSEELLGMAHILLVAGHETTVNLIANGMYALLSHPDQLAALRADMTLLDGAVEEMLRYEGPVESATYRFPVEPVDLDGTVIPAGDTVLVVLADAHRTPERFPDPHRFDIRRDTAGHLAFGHGIHFCIGAPLARLEARIAVRALLERCPDLALDVSPGELVWYPNPMIRGLKALPIRWRRGREAGRRTG

SEQ ID NO: 115 - protein, 411 aa, Saccharopolyspora erythraea
MFADVETTCCARRTLTTIDEVPGMADETALLDWLGTMREKQPVWQDRYGVWHVFRHADVQTVLRDTATFSSDPTRVIEGASPTPGMIHEIDPPEHRALRKVVSSAFTPRTISDLEPRIRDVTRSLLADAGESFDLVDVLAFPLPVTIVAELLGLPPMDHEQFGDWSGALVDIQMDDPTDPALAERIADVLNPLTAYLKARCAERRADPGDDLISRLVLAEVDGRALDDEEAANFSTALLLAGHITTTVLLGNIVRTLDEHPAHWDAAAEDPGRIPAIVEEVLRYRPPFPQMQRTTTKATEVAGVPIPADVMVNTWVLSANRDSDAHDDPDRFDPSRKSGGAAQLSFGHGVHFCLGAPLARLENRVALEEIIARFGRLTVDRDDERLRHFEQIVLGTRHLPVLAGSSPRQSA

SEQ ID NO: 116 - protein, 497 aa, Ozonium sp. BT2
MDSFIFLRSIGTKFGQLESSPAILSLTLAPILAIILLLLFRYNHRSSVKLPPGKLGLPLIGETIQLLRTLRSETPQKFFDDRLKKFGPVYMTSLIGHPTVVLCGPAGNKLVLSNEDKLVEMEGPKSFMKLIGEDSIVAKRGEDHRILRTALARFLGAQALQNYLGRMSSEIGHHFNEKWKGKDEVKVLPLVRGLIFSIASTLFFDVNDGHQQKQLHHLLETILVGSSSVPLDFPGTRYRKGLQARLKLDEILSSLIKRRRRDLRSGIASDDQDLLSVLLTFRDEKGNSLTDQGILDNFSAMFHASYDTTVAPMALIFKLLYSNPEYHEKVFQEQLEIIGNKKEGEEISWKDLKSMKYTWQAVQESLRMYPPVFGIFRKAITDIHYDGYTIPKGWRVLCSPYTTHLREEYFPEPEEFRPSRFEDEGGHVTPYTYVPFGGGLRTCPGWEFSKIEILLFVHHFVKNFSSYIPVDPNEKVLSDPLPPLPANGFSIKLFPRS

SEQ ID NO: 117 - protein, 488 aa, Lactuca sativa
MELSITTSIALATIVFFLYKLATRPKSTKKQLPEASRLPIIGHMHHLIGTMPHRGVMDLARKHGSLMHLQLGEVSTIVVSSPKWAKEILTTYDITFANRPETLTGEIIAYHNTDIVLAPYGEYWRQLRKLCTLELLSVKKVKSFQSIREEECWNLVKEVKESGSGKPINLSESIFTMIATILSRAAFGKGIKDQREFTEIVKEILRQTGGFDVADIFPSKKFLHHLSGKRARLTSIHKKLDNLINNIVAEHHVSTSSKANETLLDVLLRLKDSAEFPLTADNVKAIILDMFGAGTDTSSATVEWAISELIRCPRAMEKVQAELRQALNGKEKIQEEDIQDLAYLNLVIRETLRLHPPLPLVMPRECREPVNLAGYEIANKTKLIVNVFAINRDPEYWKDAEAFIPERFENNPNNIMGADYEYLPFGAGRRMCPGAALGLANVQLPLANILYHFNWKLPNGASHDQLDMTESFGATVQRKTELLLVPSF

SEQ ID NO: 118 - protein, 501 aa, Chaetomium chiversii
MAEFHPTAFLLPAAVTMIAGYFLCTALYNVYFHPLAKFPGPRLYAASQIPITIKRLLGDEVATFHKLHAKYGQFVRVAPGELSTINPAASRDVYGHRNPAKSIPKDFKAYYMKNQRRDGTEGLMTADDDLHRRQRKIFSPAFSDRAIREQEPLLKKYTDLLVEKAGVASDADGKVDMVMMFNFATFDFIADCVFGDSLHLLEKMEYNPFLANISAVVKFSAMRRAIRSFPYMDETFEKLIPASMKRKRMEHVKFCDDLVDRRLEKAVTNHPDFWTLVLRANEKGEGLTLGEMHQNSFLFLTAATETTSSLMSALTYLLCQNPDKMKKLVDEIRGRFKSTEEMTTVSLPPLEYLQMCIEEGLRVYPPVPGGLPRRVTADGASLDGRELPPDTVVYYAHYASYHSAAHFARPDEFHPERWASVPPSEFANDCRDAVIPFSAGPRDCIGKNLAYHEARLLLAKFLWTYDVELCEESKDWIKQKSFIVGVKRPLYVKLHRVVREK

SEQ ID NO: 119 - protein, 492 aa, Metacordyceps chlamydosporia
MNVSPQLLGYVVYTAIYNVYFHPLANFPGPKYLAASRIPLAFKRLTGEEVAMTYKLHIKYGPYVRVSPDELSTISTAATKDVYGHNTRAGGVPKDFKAYYMKNQRKDGTEGLLTAGDEEHYRQRKVFAPAFSDRAIREQEPLLKKYTDLLVAKSYEKCQTAGKVDMVMFFNFATFDFIADCVFGDSLHHLESMEYHPFLANITATVRFSAMRRVLRSFPILQAIFEAFMPKSMIKKRLEHVKFCDERVMNRLANDNPSHPDFWTLVEHAEAKGNGLTKGEMRQNGFLLLTAATETTSSLMSAITYLLCKNPEKMKKLQAEVRGAFKSTDEMNTITLPKLQYLQMAIEEGLRVYPPVPGGLPRRVVQPGTTLDGSASNMHIQSVVFYSQYASYHSPSHFARPHEFIPERWSQNPPAEFANDRLEAVQAFSAGPRDCIGKNLAYHEARMLLAKFVFTYDIELCKESSDWIKQKVYIVGAKSPLWVKLVKHERAD

SEQ ID NO: 120 - protein, 502 aa, Hypomyces subiculosus
MAVLPQVDLGHLANRDTAFVIVGAFFAWVFVVNPIYLLYFHPLSKFPGPKFWAVTRWGVSLAIISGKSHDIILDLHKKYGPILRIAPDELAFQSVSAWNDIGGHRKPGQPEMTKEPIFNEAFKDNLLGVTTREDHSRMRRILSRGFSAATFQKQEPLLKGYVDLLLSELKKRCEGGQKLIDIQTWYSFTAFDIIGDLTFGESFGSLDSGGHHPWASLIFETTRFVILANCLKRINRAFLPVLLFITPKGFGRRLKENQQLTDAKIAKRRALGASRPDYMTAMLGNDEKGAKLSDTEITSNCTALILGGAETISSALSGTTYYLTKNPEAMAKVIEEVRSAFSSEDEITLTGTGHLKYLNAVITESLRMFPPFAGASPRQVPRGGATIAGEFIPAGTSVGIWHWSMARCPDFFTHANEFHPERWLDDPRFDNDKKDASQPFAVGPRNCIGMNLTYVELRLILARLFWNFDIKLDKSCDNWVDDMVEYFGWEKIPLMVSLTPRS

SEQ ID NO: 121 - protein, 399 aa, Streptomyces nodosus
MTAETEMTTFAPGCPVAFPLRRPGRPFPPPEYADYRAGEGLVRSELPASGPVWLVTRHEDVRTVLTDPRISADPSRPGFPRARRTGGAPSQSEIPGWFVALDPPEHDRFRKTLIPEFTVRKVRELRPAIQQIVDERIDALLAAGNSADLIADFALSVPSLVISDLLGVPKADRDFFEAKTKVLVTLSSTDEQRDEASKALLRYLNRLIQIKGRRPGEDLISRLLQAGTMNRQELSGVSMLLLIAGHETTANNIGLGVVQLLTNPQWIGDDRIVEEMLRYYSVADLVSFRVAVEDVEIGGQLIKAGEGIVPLIAAANHDGSVFDKPEEFNPERSARSHVAFGYGVHQCLGQNLVRVEMEIAYRTLFERIPTLELAVPVEELPLKYDGVLFGLHELPVTWS

SEQ ID NO: 122 - protein, 396 aa, Streptomyces nodosus
MVNPTPPPSLEDAAPSVLRLSPLLRELQMRAPVTKIRTPAGDEGWLVTRHAELKQLLHDERLARAHADPANAPRYVKSPLMDLLIMDDVEAARAAHAELRTLLTPQFSARRVLNMMPMVEGIAEQILNGFAAQEQPADLRGNFSLPYSLTVLCALIGIPLQEQGQLLAVLGEMATLNDAESVARSQAKLFGLLTDLAGRKRAEPGDDVISRLCETVPEDERIGPIAASLLFAGLDSVATHVDLGVVLFTQYPDQLKEALADEKLMRSGVEEILRAAKAGGSGAALPRYATDDIEIADVTIRTGDLVLLDFTLVNFDEAVFDDADLFDIRRSPNEHLTFGHGMWHCIGAPLARMMLKTAYTQLFTRLPGLKLASSVEELQVTSGQLNGGLTELPVTW

SEQ ID NO: 123 - protein, 201 aa, Haemophilus parasuis
MLFDGRVNGKKHFLSIAKSFLELFDYFKKSFNDSDENISDMVVTYIAAHQTTMQLIVATLYTIHNFNLTVDKSNIKNIILESSRLYSPVLSVGRIVTKDIHYCRNIIKKGDRAIFYTGLANFDSNSFVLPFTFNLDRINKPLSFGVGIHKCIGMGISLDFTKIFVEFILEKYKLKNVSIFKVDDGASAIGISSFTIEINKK

SEQ ID NO: 124 - protein, 419 aa, Sorangium cellulosum; identical to SEQ ID NO: 113

SEQ ID NO: 125 - protein, 404 aa, Amycolatopsis orientalis
MTDVEETTATLPLARKCPFSPPPEYERLRRESPVSRVGLPSGQTAWALTRLEDIREMLSSPHFSSDRQSPSFPLMVARQIRREDKPFRPSLIAMDPPEHGKARRDVVGEFTVKRMKALQPRIQQIVDEHIDALLAGPKPADLVQALSLPVPSLVICELLGVPYSDHEFFQSCSSRMLSREVTAEERMTAFESLENYLDELVTKKEANATEDDLLGRQILKQRESGEADHGELVGLAFLLLIAGHETTANMISLGTVTLLENPDQLAKIKADPGKTLAAIEELLRIFTIAETATSRFATADVEIGGTLIRAGEGVVGLSNAGNHDPDGFENPDTFDIERGARHHVAFGFGVHQCLGQNLARLELQIVFDTLFRRVPGIRIAVPVDELPFKHDSTIYGLHALPVTW

SEQ ID NO: 126 - protein, 397 aa, Paenibacillus sp. HGF5
MNVNESLKNALFTKEFTHNPYPVYEKLRQSDPIMNLQFPDGRHGWLISSYAEAVEALKDGRFSKDVTKAMGAEQTSVFSTNMLFSDPPDHKRLRGLVQKGFTPQRIADMRSHIQEIADNLLDAVSSKDTMNLIDEYAFKLPIIVISEILGVPAEDQDKFRVWSNSIIGASNQEMNEQVVQHMNEFIDYLKDWFAKVRELPGDDMISQLVIAENQGDRLSEQELYGVVTLMIIAGHETTVNLIGNGVLALLEHPEQRKLLQEQPERIHGAIEEMLRYNGPVEFSTSRWAAEDLEFHGVHMKKGDLVVIALNSANRDSAQFEDPDLFDITREKSQHLAFGKGIHLCLGAPLARLEGEIAINTLLRRFPDFELQGNIDELEWRPGMIVRGVKEIPISLRS

SEQ ID NO: 127 - protein, 527 aa, Streptomyces coelicolor
MAQTAREPARDGLPKGFRSAELGWPELHRIPHPPYRLPLLGDVVGASRRTPMQDSLRYARRLGPIFRRRAFGKEFVFVWGAALAADLADEARFAKHVGLGVANLRPVAGDGLFTAYNHEPNWQLAHDVLAPGFSREAMAGYHVMMLDVAARLTGHWDLAEASGRAVDVPGDMTKLTLETIARTGFGHDFGSFERSRLHPFVTAMVGTLGYAQRLNTVPAPLAPWLLRDASRRNAADIAHLNRTVDDLVRERRANGGTGGGTGSGSGSGDLLDRMLETAHPRTGERLSPQNVRRQVITFLVAGHETTSGALSFALHYLAQHPDVAARARAEVDRVWGDTEAPGYEQVAKLRYVRRVLDESLRLWPTAPGFAREAREDTVLGGTHPMRRGAWALVLTGMLHRDPEVWGADAERFDPDRFDAKAVRSRAPHTFKPFGTGARACIGRQFALHEATLVLGLLLRRYELRPEPGYRLRVTERLTLMPEGLRLHLVRRTAAAPAPGRRTAAPGAADDAGDTVSAPGCPVHRAGD

SEQ ID NO: 128 - protein, 504 aa, Streptomyces avermitilis
MAQSTRTVIPKGFRSAELGWPELHRIPHPPHRLPVVGDVLGVNVRTPVQDSLRIGRRLGPVFRRKAFGKEIVFVGGADLAAELADESRFAKHVGLGVANLRPVAGDGLFTAYNHEPNWQLGHDVLAPGFSREAMAGYHPMMLAVTERLIDHWDREQTAGRAVDVPGDMTKLTLETIARTGFGHDFGSFERARPHPFVTAMVGTLTYAQRRNVVPEPLAPLLLRTATRRNAADLAYLNRTVDALVRARRTTSGEGDLLDRMLDTARPGTGERLAPENIRRQVITFLVAGHETTSGALSFALHYLSRHPDVAARARAEVDRVWGGTARPGYDQVAKLRYVRRVLDESLRLWPTAPAFAREARRDTVLGGVHPMREGAWALVLTAMLHRDPGVWGADAERFDPDRFDAQAVRSRAAHTFKPFGTGARACIGRQFALHEATLVLGLLLRRYELRAEPGYRLRVAERLTLMPEGLRLRLDRRVPAVEDVPVANPEVSSGPRCPVTGAGE

SEQ ID NO: 129 - protein, 510 aa, Rhodococcus erythropolis
MNGPRGSRTRPRRASLVNLAVLGVVLVHTVLMSADKCPYPKSATRAGEITAVQPQVFESIPSPAWRLPLLGDLLTVDSEKPIQKEMALASKLGPIFEWKIVNNRVTVVSGVDLVAEVNNEALWAKSVGLPILKLRKVAEDGLFTAFNSEPNWRKAHNILSEGFSRSALRNYHPSMLRALGGLTDSWDRVADAGETIDASSDANKLALDVIGLAGFGYDFASFIGEEHPFVGAMSRVLAHVNSTSNDIPFLRKLRGNGADLQNEKDIALLRTVVDNVIAERQSKPGEHQDDLLDLMLHSADAETGEKLDPVNIRNQVFTFLVAGNETTAGTLAFALYFLSRHPDVADTARAEVADVTAGETPAFEDVARMRYLRRVVDETLRLWPSAPGYFRKVRTDTTLGGRYDMPKGSWVFVLLPQLHRDPVWGEDPESFDPDRFKPENVKKRPAHAYRPFGTGPRACIGRQFALHEAVLALAIILQRYNFQSDPEYKLDIRETLSLKPVGFELSLQRR

SEQ ID NO: 130 - protein, 473 aa, Nocardia farcinica
MAVTTSTTSGGHSNPPLPHPKWRLPIINDLLTINPIKPTLTSLRDAEQLGGIFERRLVDWPMIVVSDSELITEICDERNWAKHLGVPLRKMRHIARDGLFTARNDEPNWAKAHAVLAPAFTKEAMRSYHQTMLTTIGELLDYWAKRDGQWVDVGEDMNKLTLEIIARTGFDYTFDSFTRSEVHPFVAAMLRGLTYISRNSNMPPFLQKTIGARAAARHSRDITYVRTVVDDVIKARQASGTVGDHHDLLDRMLTVPDPASDELLDTTNVRSQILTMLVAGHETSAGVLAFALYELSRRPELVAAARAEIETRFADGDLSTIAYDDVAKLRTLRRIVDETLRLYPVAPGFFREARHETTIGGGRYRFGPGDWVLVLTLHAHRDPATWGPDAGEFQPDRWLPERMRSLDGRQVFKPFGTGLRACIGRQFAYHEIVLALAHILHTFEFTPDPGYELDIAEQITLKPHRFRLRLNHR

SEQ ID NO: 131 - protein, 414 aa, Novosphingobium aromaticivorans
MLPHDRGQNSTRRITAMEAPAHVPADRVVDIDIYMPPGLAEHGFHKAWSDLSAGNPAVVWTPRNEGHWIALGGEALQEVQSDPERFSSRIIVLPKSVGEMHGLIPTTIDPPEHRPYRQLLNAHLNPGAIRGLSESIRQTAVDLIEGFAAQGHCNFTAQYAEQFPIRVFMALVGIEASEAPRIRHWAECMTRPGMDMTFDEAKAVFFDYVGPLVDARRETPGEDMISAMINADLGDGRRLTRDEALSVVTQVLIAGLDTVVNVLGFIMRELAGNPALRADLRQRGADILPVVHELFRRFGLVSIAREVRRDIEFHGVHLKAGDMIAIPTQVHGLDPRVNPDPLAIDPSRKRARHSTFGSGPHMCPGQELARKEVAITLEEWLRRIPDFALGPNSDLSPVPGIVGALRRVELVWNT

SEQ ID NO: 132 - protein, 396 aa, Novosphingobium aromaticivorans
MIPAHVPADRVVDFDIFNPPGVEQDYFAAWKTLLDGPGLVWSTANGGHWIAARGDVVRELWGDAERLSSQCLAVTPGLGKVMQFIPLQQDGAEHKAFRTPVMKGLASRFVVALEPKVQAVARKLMESLRPRGSCDFVSDFAEILPLNIFLTLIDVPLEDRPRLRQLGVQLTRPDGSMTVEQLKQAADDYLWPFIEKRMAQPGDDLFSRILSEPVGGRPWTVDEARRMCRNLLFGGLDTVAAMIGMVALHLARHPEDQRLLRERPDLIPAAADELMRRYPTVAVSRNAVADVDADGVTIRKGDLVYLPSVLHNLDPASFEAPEEVRFDRGLAPIRHTTMGVGAHRCVGAGLARMEVIVFLREWLGGMPEFALAPDKAVTMKGGNVGACTALPLVWRA

SEQ ID NO: 133 - protein, 421 aa, Novosphingobium aromaticivorans
MNAQTSTATQKHRVAPPPHVPGHLIREIDAYDLDGLEQGFHEAWKRVQQPDTPPLVWTPFTGGHWIATRGTLIDEIYRSPERFSSRVIWVPREAGEAYDMVPTKLDPPEHTPYRKAIDKGLNLAEIRKLEDQIRTIAVEIIEGFADRGHCEFGSEFSTVFPVRVFLALAGLPVEDATKLGLLANEMTRPSGNTPEEQGRSLEAANKGFFEYVAPIIAARRGGSGTDLITRILNVEIDGKPMPDDRALGLVSLLLLGGLDTVVNFLGFMMIYLSRHPETVAEMRREPLKLQRGVEELFRRFAVVSDARYVVSDMEFHGTMLKEGDLILLPTALHGLDDRHHDDPMTVDLSRRDVTHSTFAQGPHRCAGMHLARLEVTVMLQEWLARIPEFRLKDRAVPIYHSGIVAAVENIPLEWEPQRVSA

SEQ ID NO: 134 - protein, 432 aa, Novosphingobium aromaticivorans
MGTTRMDTFNPQESRLATNFDEAVRAKVERPANVPEDRVYEIDMYALNGIEDGYHEAWKKVQHPGIPDLIWTPFTGGHWIATNGDTVKEVYSDPTRFSSEVIFLPKEAGEKYQMVPTKMDPPEHTPYRKALDKGLNLAKIRKVEDKVREVASSLIDSFAARGECDFAAEYAELFPVHVFMALADLPLEDIPVLSEYARQMTRPEGNTPEEMATDLEAGNNGFYAYVDPIIRARVGGDGDDLITLMVNSEINGERIAHDKAQGLISLLLLGGLDTVVNFLSFFMIHLARHPELVAELRSDPLKLMRGAEEMFRRFPVVSEARMVAKDQEYKGVFLKRGDMILLPTALHGLDDAANPEPWKLDFSRRSISHSTFGGGPHRCAGMHLARMEVIVTLEEWLKRIPEFSFKEGETPIYHSGIVAAVENVPLVWPIAR

SEQ ID NO: 135 - protein, 417 aa, Sphingomonas sp.
MPEHVPETMSRARAPRPEHIPEQYVHEIDMYALEGIEQGYHEAWKNIPKPDMPDLIWTPFTGGHWIATNGDTVREVYSDPTRFSSEVIFLPKEAGEKYEMVPTRMDPPEHTPYRKALDKGLSLAQIRKVESKVRKVAVDLIDSFVSRGECDFSAEYANVFPVRVFMALADLPESDVPTLSRFAKMMTRPEGNTPEEMAKHLEEGNKGFFAYVEPIIQARRGKEGEDLITVMVNAEINGERITHDKALGLISLLLLGGLDTVVNFLSFMMIHLAKNPQVVEELRADPLKLMRSAEEMFRRFPVVSEARMVAKDQDFRGIELKRGDMILLPTALHGLDDQLNDDPWRINLERRGISHSTFGGGPHRCAGLHLARMEVIVTIEEWLKRIPTFAMKPGAQPIYHSGIVAAVDNVPLIWSER

SEQ ID NO: 136 - protein, 406 aa, Streptomyces griseolus
MTDTATTPQTTDAPAFPSNRSCPYQLPDGYAQLRDTPGPLHRVTLYDGRQAWVVTKHEAARKLLGDPRLSSNRTDDNFPATSPRFEAVRESPQAFIGLDPPEHGTRRRMTISEFTVKRIKGMRPEVEEVVHGFLDEMLAAGPTADLVSQFALPVPSMVICRLLGVPYADHEFFQDASKRLVQSTDAQSALTARNDLAGYLDGLITQFQTEPGAGLVGALVADQLANGEIDREELISTAMLLLIAGHETTASMTSLSVITLLDHPEQYAALRADRSLVPGAVEELLRYLAIADIAGGRVATADIEVEGHLIRAGEGVIVVNSIANRDGTVYEDPDALDIHRSARHHLAFGFGVHQCLGQNLARLELEVILNALMDRVPTLRLAVPVEQLVLRPGTTIQGVNELPVTW

SEQ ID NO: 137 - protein, 403 aa, Streptomyces griseolus
MTTAERTAPPDALTVPASRAPGCPFDPAPDVTEAARTEPVTRATLWDGSSCWLVTRHQDVRAVLGDPRFSADAHRTGFPFLTAGGREIIGTNPTFLRMDDPEHARLRRMLTADFIVKKVEAMRPEVQRLADDLVDRMTTGRTSADLVTEFALPLPSLVICLLLGVPYEDHAFFQERSRVLLTLRSTPEEVRAAQDELLEYLARLARTKRERPDDAIISRLVARGELDDTQIATMGRLLLVAGHETTANMTALSTLVLLRNPDQLARLRAEPALVKGAVEELLRYLTIVHNGVPRIATEDVLIGGRTIAAGEGVLCMISSANRDAEVFPGGDDLDVARDARRHVAFGFGVHQCLGQPLARVELQIAIETLLRRLPDLRLAVPHEEIPFRGDMAIYGVHSLPIAW

SEQ ID NO: 138 - protein, 381 aa, Streptomyces sp.
MTQAAPVTFSTVRENYFGPPAEMQALRHKAPVTRTAFADGRPGWLVTGYSAARAVLSDSRFTARGEREHPAVPRAATLEDERCRRLIAGQFTARRMRQLTGRTERIVREHLDAMEHMGSPADLVEHFALPVPSLVIAELLGVPPPDREHFQHDTLRWGGFGRSTEEVTEAFVSLGGQLQRLVRLKRTEPGDDLLSGLIAADPALTDEELASIAFLLLVAGHGTTAHQIALGAFLLLEHPDQLAALRADPALTESAVEELLRHLSVVHHGPTRAALQDADIEGTPVKAGEVVVVSLGAANRDPARFERPDAVDVTREDTGHLAFGHGMHQCLGRQLARIELRVALTALLERFPHLRLACPAAEIPLRHDMQVYGADRLPVAW

SEQ ID NO: 139 - protein, 412 aa, Streptomyces griseus
MTESTTDPARQNLDPTSPAPATSFPQDRGCPYHPPAGYAPLREGRPLSRVTLFDGRPVWAVTGHALARRLLADPRLSTDRSHPDFPVPAERFAGAQRRRVALLGVDDPEHNTQRRMLIPTFSVKRIGALRPRIQETVDRLLDAMERQGPPAELVSAFALPVPSMVICALLGVPYADHAFFEERSQRLLRGPGADDVNRARDELEEYLGALIDRKRAEPGDGLLDELIHRDHPDGPVDREQLVAFAVILLIAGHETTANMISLGTFTLLSHPEQLAALRAGGTSTAVVVEELLRFLSIAEGLQRLATEDMEVDGATIRKGEGVVFSTSLINRDADVFPRAETLDWDRPARHHLAFGFGVHQCLGQNLARAELDIAMRTLFERLPGLRLAVPAHEIRHKPGDTIQGLLDLPVAW

SEQ ID NO: 140 - protein, 399 aa, Rhodococcus fascians
MAGTADLPLEMRRNGLNPTEELAQVRDRDGVIPVGELYGAPAFLVCRYEDVRRIFADSNRFSNAHTPMFAIPSGGDVIEDELAAMRAGNLIGLDPPDHTRLRHILAAEFSVHRLSRLQPRIAEIVDSALDGLEQAGQPADLMDRYALPVSLLVLCELLGVPYADRDELRDRTARLLDLSASAEQRAVAQREDRRYMATLVTRAQEQPGDDLLGILARKIGDNLSTDELISIISLIMLGGHETTASMIGLSVLALLHHPEQAAMMIEDPNCVNSGIEELLRWLSVAHSQPPRMAVTEVQIAGVTIPAGSFVIPSLLAANRDSNLTDRPDDLDITRGVAGHLAFGHGVHFCLGHSLARMTLRTAVPAVLRRFPDLALSPSHDVRLRSASIVLGLEELQLTW

SEQ ID NO: 141 - protein, 407 aa, Streptomyces lavendulae
MSDTEQHAPTLPRQRTCPFSPPPELEELRRTDPISRMRFADDSPGWLLTRHADVRAALADPGVSSHPGKAPQPWRNLAPEMRAEHYLPGFLIFMDPPDHTRYRRLLTKWFTMRAIRKLEPRIEQIVTETLDAMEAQGGTVDLVQSFALPIPLLVICELMGIRYEEREEFMDMVLRLQALDATPEELGALGARMNEFMMKLAAAKRANPGDDLLSHLAHDPDADPALTDLEIAGIGVLMLIAGHETSANMLGVGTYTLLENADQWALLRDDISLIDRAVEELLRHQTIVQQGLPRGVTRDMEIAGHQVKTGESLLASLPAANRDPAVFPDPDRLDITREHNPHLAFGHGIHLCLGMELARVEMRQAWRGLVTRFPGLRMAAAPEDIRWRDDQIVYGVYNLPVTWDEAK

SEQ ID NO: 142 - protein, 398 aa, Streptomyces noursei
MSTEADARTAAPQCPVAFPLRRPGRPFPPPEYATYRGGAGLVRSELPSGPVWLVTRHEDVRAVLTDPRISADPSKPGFPKAGRTGGAPSQYEVPGWFVAMDPPEHGRFRKTLIPEFTVRKVRELRPVIQQIVDERIDAMLAAGTSADLVESFALPVPSLVISSLLGVPKVDRDFFEDRTRVLVRLSSTDEERDKATQALLRYLGRLIQIKQRRPGDDLISRLIAAGTLSRQELSGVAMLLLIAGHETTANNIGLGVVQLLTNPRWIGDDRIVEELLRYYSVADLVAFRVAVEDVEIGGQLIRAGEGIVPLIAAANHDATAFAAPSEFDPERSARSHVAFGYGVHQCLGQNLVREEMDIAYRTLFARIPSLTLAVPVEELPLKYDGVLFGLHELPVTWK

SEQ ID NO: 143 - protein, 396 aa, Amycolatopsis mediterranei
MTDAISFEVPWDRTDKFDPPAVFDSLREERPLAKMVYPDGHVGWIVSSYELVREVLSDLRFSHSCEVGHFPVTHQGQVIPTHPLIPGMFIHMDPPEHTRYRKLLTGEFTVRRASRLIPRAEAVAAEQIEVMRAKGAPADVVMDFAKPLVLRMLGELVGLPYEERDRYVPAVTLLHDAEADPAEAAAAYEVAGKFFDEVIERRRQRPQDDLISSLVTEDLTQEELRNIVTLLLFAGYETTEGALATGVFALLHHTDQLAALRAEPEKLDAAIEELLRYLTVNQYHTYRTALEDVKLEGELIKKGDTVTVSLPAANRDPAKFGCPAELDIERDTSGHVAFGFGIHQCLGQNLARIELRAGFTALLRAFPELRLAVPADEVPLRLKGSVFSVKKLPVSW

SEQ ID NO: 144 - protein, 410 aa, Streptomyces tendae
MTETFGHDIPSFPMARECPMHPPAEYRKLRVQEPVSRVRMPDGQVAWLVLKHDLARKLLADPRVSADRLHPAFPGRLTAEQRTATERVRRLSTRRSMIHLDGDEHGAHRKILTGEFSLRRIAALRPRVQEIVDRSIDEMLAAPQPADLVEHVSQAVPSLVICELLGVPHEQRRDFHEWAGMLVSRSVSIRERAAASDALNDFLEDLVTEKERGEPTDDLIGRLIARNRRTPVMTHDEIVGTAVMLLIAGHQTTANMISLGVVALLENPEHKARIAADPSLLPPAIEEMLRYFSVVENAPARVATEDIEIGGVTIRKDEGIVVSGLAADWDDEVFEHPDRLDFERGARHHVAFGYGVHQCLGQNLARVELEIVFETLLRRVPGLSLAVPAEELPYKDDAGIYGIYRVPVNC

SEQ ID NO: 145 - protein, 420 aa, Streptomyces fradiae
MSSSGDARPSQKGILLPAARANDTDEAAGRRSIAWPVARTCPFSPPEQYAALRAEEPIARAELWDGAPVWLISRQDHVRALLADPRVSIHPAKLPRLSPSDGEAEASRSLLTLDPPDHGALRGHFIPEFGLRRVRDVRPSVEQIVTGLLDDLTARGDEADLLADFALPMATQVICRLLDIPYEDRDYFQERTEQATRPAAGEEALEALLELRDYLDRLISGKTGRESGDGMLGSMVAQARGGGLSHADVLDNAVLLLAAGHETTASMVTMSVLVLLQHPTAWRELTVNPGLLPGAVDELLRYLSIADGLRRSATADIEIDGHTIRAGDGLVFLLAAANRDEAVFSEPEAFDIHRSARRHVAFGYGPHQCLGQNLARMELEVALGAVLERLPALRPTTDVAGLRLKSDSAVFGVYELPVAW

SEQ ID NO: 146 - protein, 407 aa, Streptomyces clavuligerus
MNEAAPQSDQVAPAYPMHRVCPVDPPPQLAGLRSQKAASRVTLWDGSQVWLVTSHAGARAVLGDRRFTAVTSAPGFPMLTRTSQLVRANPESASFIRMDDPQHSRLRSMLTRDFLARRAEALRPAVRELLDEILGGLVKGERPVDLVAGLTIPVPSRVITLLFGAGDDRREFIEDRSAVLIDRGYTPEQVAKARDELDGYLRELVEERIENPGTDLISRLVIDQVRPGHLRVEEMVPMCRLLLVAGHGTTTSQASLSLLSLLTDPELAGRLTEDPALLPKAVEELLRFHSIVQNGLARAAVEDVQLDDVLIRAGEGVVLSLSAGNRDETVFPDPDRVDVDRDARRHLAFGHGMHQCLGQWLARVELEEILAAVLRWMPGARLAVPFEELDFRHEVSSYGLGALPVTW

SEQ ID NO: 147 - protein, 399 aa, Streptomyces avermitilis
MPEPTADAPTVPKARSCPFLPPDGIADIRAAAPVTRATFTSGHEAWLVTGYEEVRALLRDSSFSVQVPHALHTQDGVVTQKPGRGSLLWQDEPEHTSDRKLLAKEFTVRRMQALRPNIQRIVDEHLDAIEARGGPVDLVKTFANAVPSMVISDLFGVPVERRAEFQDIAEAMMRVDQDAAATEAAGMRLGGLLYQLVQERRANPGDDLISALITTEDPDGVVDDMFLMNAAGTLLIAAHDTTACMIGLGTALLLDSPDQLALLREDPSLVGNAVEELLRYLTIGQFGGERVATRDVELGGVRIAKGEQVVAHVLAADFDPAFVEEPERFDITRRPAPHLAFGFGAHQCIGQQLARIELQIVFETLFRRLPGLRLAKPVEELRFRHDMVFYGVHELPVTW

SEQ ID NO: 148 - protein, 413 aa, Streptomyces sp.
MADTLTDAAPDTDGRVPEYPMPRATGCPLAPSPAAAELRGDRPITRVRIWNGSTPWLITRHADQRTLLTDPRVSNDDHEPDFPHVNAHRAAIAPHTPKLITNTDAPEHTRLRRSVNAPFLVKRIEAMRPAVQKIVDDLIDDMLAGPSPADLLTALALPVPSLVIAELLGVPYEDHHFFQENSNRVLDNSLTAEEAQESSRALGGYLDTLFRTKLEQPGEDVLSEMGSKVKAGEMTHQEAVSMGVAMLIAGHETTATMISLGTLALFEHPDQLAVLRDTEDPKVVAGAVDELLRYLSIVHSGLRRVAKGDIEIDGRLIRKGDGLLFDLQTANWDPNAFPGAERLDLARPARQHNAFGYGPHQCLGQNLARLELQVVYGTLYRRVLTLRPAVPVDQLAFNHTGTTYGVKCLPVTW

SEQ ID NO: 149 - protein, 409 aa, Mycobacterium vanbaalenii
MTETLAQEAVSVPEYPMERTAGCPFAPPQQMLEMNQVKPLSRVRIWNGTTPWLVTGHEVARTLFADSRVSVDDRREGFPHWNEHMLSTVDKRPRSVFTSDAEEHTRFRRMLSKPFTFRRVEALRPVIQQVTDECIDEILAGPQPADMVAKLALPVPTRVISDMLGVPYEDHEFFQEHANAGLARYAAADAMQKGAMSLHQYLINLVEEKQAHPAEDAVSDLAERVTAGEISVKEAAQLGTGLLIAGHETTANMIGIGICALLENPEQAALLRDSDDPKFIANAVEELMRYLSIIQNGQRRVATEDIEIGGETIRAGEGIILDLAPANWDARAFPEPDKLDLTRDATQQLGFGYGRHQCVGQQLARAELQIVFHTLLRRIPTMKPAIPLEEVPFKHDRLAYGVYELPVTW

SEQ ID NO: 150 - protein, 410 aa, Mycobacterium smegmatis
MSETLTQPSATDIPGYPMERAAACPFAPPPQMLDMNKAKGLSRVRIWDGSTPWLITGHEEARALFADSRVSVDDRRPGFPHWNEHMLATVHKRPRSVFTSDAEEHTRFRRMLSKPFTFRRVEGLRPAIQKITDECIDAILAGPQPADIVDKLALPVPTVVISEMLGVPYEDHEFFQEHANAGLARYAAADAMQKGAMSLHQYLIDLIEKKQAEPAEDAVSDLAERVTAGELSVKEAAQLGTGLLIAGHETTANMIGIGILALLENPEQADFLRNAEDPKVIANAVEELMRYLSIIQTGQRRVAVEDIEIGGETIKAGEGIIIDLVPANWDAKAFPEPDKLDLTRDAGQQLGFGYGRHQCVGQQLARAELQIVFHTLLRRIPTLRLAIPLEEVPFKHDRLAYGVYELPVAW

SEQ ID NO: 151 - protein, 401 aa, Mycobacterium smegmatis
MTQAQALPPLHIRRDAFDPTPELGEIRAGEGVHVTVNPFGMQVYLVTRHEDVKTVLSDHERFSNSRPPGFVLPGAPQISAEEQASNRAGNLLGLDPPEHQRLRRMLTPEFTIRRIKRLEPRIVEIVDAHLDAMESAGPPADIVADFALPIPSLVICELLGVPYEDRTDFQQRSARQLDLSAPMPERLELQRQGRAYMRGLVERSRTRPGDDILGMLVREHGTELTDDELIGIAGLLLLAGHETTSNMLGLGVLALLRHPDQLACVRDDPDAVGPAIEELLRWLSIVSTALPRITTTDVELAGVTIPAGHLVFASLPAGNRDPEFIDDPDTLDIRRGAPGHLAFGHGVHHCLGAPLARMEMRIALPALLRRFPTLALAEPFEDVRWRPFHFIYGLQSLAVAW

What is claimed is:

1. A method for acquiring a functional fingerprint (hereinafter "fingerprint") of a monooxygenase or a plurality of monooxygenases, the method comprising the steps of:
   a. providing a set of fingerprint probes comprising at least two fingerprint probes;
   b. providing a monooxygenase or a plurality of monooxygenases;
   c. contacting the monooxygenase or each member of the plurality of monooxygenases with each probe of the set of fingerprint probes in parallel;
   d. acquiring data, the data characterizing the activity of the monooxygenase or the activity of each member of the plurality of monooxygenases on each probe of the set of fingerprint probes; and
   e. generating a fingerprint of the monooxygenase or of each member of the plurality of monooxygenases, the generating step comprising the step of compiling the data characterizing the activity of the monooxygenase or the member of the plurality of monooxygenases on each probe of the set of fingerprint probes, wherein at least one of the fingerprint probes of the set is an organic molecule of general formula:

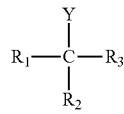

wherein Y is —OCH$_3$, —NHCH$_3$, —N(CH$_3$)$_2$, or —SCH$_3$, and wherein R$_1$, R$_2$, and R$_3$ are independently selected from the group consisting of hydrogen, aliphatic, aryl, substituted aliphatic, substituted aryl, heteroatom-containing aliphatic, heteroatom-containing aryl, substituted heteroatom-containing aliphatic, substituted heteroatom-containing aryl, alkoxy, aryloxy, and functional groups (FG) or are taken together to form a ring, such that the carbon atom is a secondary or tertiary carbon atom.

2. The method of claim 1, wherein at least one of the fingerprint probes of the set is an organic molecule of general formula:

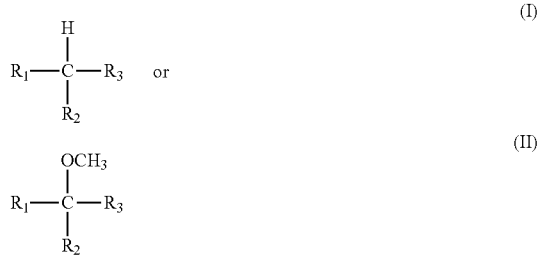

wherein $R_1$, $R_2$, and $R_3$ are independently selected from the group consisting of hydrogen, aliphatic, aryl, substituted aliphatic, substituted aryl, heteroatom-containing aliphatic, heteroatom-containing aryl, substituted heteroatom-containing aliphatic, substituted heteroatom-containing aryl, alkoxy, aryloxy, and functional groups (FG) or are taken together to form a ring, such that the carbon atom is a secondary or tertiary carbon atom.

3. The method of claim 2, wherein $R_1$, $R_2$, and $R_3$ are independently selected from the group consisting of hydrogen, $C_1$-$C_{24}$ alkyl, $C_1$-$C_{24}$ substituted alkyl, $C_1$-$C_{24}$ substituted heteroatom-containing alkyl, $C_1$-$C_{24}$ substituted heteroatom-containing alkyl, $C_2$-$C_{24}$ alkenyl, $C_2$-$C_{24}$ substituted alkenyl, $C_2$-$C_{24}$ substituted heteroatom-containing alkenyl, $C_2$-$C_{24}$ substituted heteroatom-containing alkenyl, $C_5$-$C_{24}$ aryl, $C_5$-$C_{24}$ substituted aryl, $C_5$-$C_{24}$ substituted heteroatom-containing aryl, $C_5$-$C_{24}$ substituted heteroatom-containing aryl, $C_1$-$C_{24}$ alkoxy, $C_5$-$C_{24}$ aryloxy groups.

4. The method of claim 2, wherein $R_1$ comprises a chemical structure selected from the group consisting of $C_3$-$C_{20}$ cycloalkane, decalin, adamantane, norbornane, bicyclo[2.2.2]octane, bicyclo[3.2.1]octane, bicyclo[3.1.1]heptanes, spiro[5.5]undecane, spiro[4.5]decane, octahydro-1H-indene, decahydroazulene, decahydro-1H-benzo[7]annulene, octahydro-1H-3a,7-methanoazulene, decahydro-1H-cyclopenta[a]pentalene, tetradecahydrophenanthrene, dodecahydro-1H-cyclopenta[a]naphthalene, dodecahydro-1H-fluorene, tetradecahydroanthracene, cembrane, tetradecahydro-6,10-methanobenzo[10]annulene, hexadecahydro-1H-cyclopenta[a]phenanthrene, gonane, docosahydropicene, icosahydro-1H-cyclopenta[a]chrysene, benzene, napthene, anthracene, pyrrole, furan, thiophene, azolidine, oxolane, thiolane, imidazolidine, pyrazolidine, imidazole, imidazoline, pyrazole, pyrazoline, oxazolidine, isoxazolidine, oxazole, oxazoline, isoxazole, isoxazoline, thiazolidine, isothiazolidine, thiazole, thiazoline, isothiazole, isothiazoline, dioxolane, oxathiolane, dithiolane, dithiazole, furazan, oxadiazole, thiadiazole, tetrazole, piperidine, pyridine, tetrahydropyran, pyran, thiane, thiopyran, piperazine, diazines, morpholine, oxazine, thiazine, dithiane, dioxane, dioxin, triazine, trioxane, tetrazine, azepane, azepine, oxepane, oxepine, thiepane, thiepine, diazepine, thiazepine, azetidine, oxetane, thietane, pyrrolidine, tetrahydrofuran, tetrahydrothiophene, pyrrole, furan, thiophene, piperidine, tetrahydropyran, thiane, pyridine, azepane, oxepane, thiepane, azepine, oxepine, thiepine, indole, isoindole, quinoline, isoquinoline, benzofurane, benzothiophene, benzazepine, and derivatives of these chemical structures wherein at least one hydrogen atom is substituted with a non-hydrogen atom.

5. The method of claim 1, wherein at least one of the fingerprint probes of the set is a naturally occurring terpene or a derivative of a naturally occurring terpene, wherein at least one hydrogen atom is substituted with a non-hydrogen atom.

6. The method of claim 5, wherein at least one of the fingerprint probes is selected from the group consisting of hemiterpene, monoterpene, sesquiterpene, diterpene, sesterterpene, triterpene, tetraterpene, polyterpene, substituted hemiterpene, substituted monoterpene, substituted sesquiterpene, substituted diterpene, substituted sesterterpene, substituted triterpene, substituted tetraterpene, substituted polyterpene.

7. The method of claim 1, wherein the monooxygenase or at least one member of the plurality of monooxygenases is an enzyme that can catalyze the insertion of an oxygen atom into a chemical bond or the addition of an oxygen atom to another atom.

8. The method of claim 7, wherein the monooxygenase or the at least one member of the plurality of monooxygenases catalyze the insertion of an oxygen atom into a chemical bond or an atom using an oxygen source selected from the group consisting of molecular oxygen, hydrogen peroxide, and peroxyacid and salts thereof.

9. The method of claim 7, wherein the monooxygenase or the at least one member of the plurality of monooxygenases is a heme-dependent, flavin-dependent, copper-dependent, non-heme iron-dependent, pterin-dependent, or a cofactor-independent monooxygenase wherein the monooxygenase is capable of catalyzing a hydroxylation reaction.

10. The method of claim 9, wherein the monooxygenase or the at least one member of the plurality of monooxygenases is a heme-dependent monooxygenase.

11. The method of claim 10, wherein the heme-dependent monooxygenase is a P450 monooxygenase.

12. The method of claim 11, wherein the P450 monooxygenase is a naturally occurring P450 monooxygenase or an engineered variant of a naturally occurring P450 monooxygenase.

13. The method of claim 12, wherein the P450 monooxygenase is selected from the group consisting of SEQ ID NOs 1-151, and variants thereof.

14. The method of claim 9, wherein the monooxygenase is a flavin-dependent monooxygenase.

15. The method of claim 14, wherein the flavin-dependent monooxygenase is a naturally occurring flavin-dependent monooxygenase or an engineered variant thereof.

16. The method of claim 14, wherein the flavin-dependent monooxygenase is selected from the group consisting of 4-hydroxybenzoate 3-monooxygenase (EC 1.14.13.2), 2-hydroxybiphenyl 3-monooxygenase (EC 1.14.13.44), phenol 2-monooxygenase, salicylate 1-monooxygenase (EC 1.14.13.1), hydroxybiphenyl 3-monooxygenase, cyclohexanone monooxygenase (EC 1.14.13.22), 4-hydroxyacetophenone monooxygenase (EC 1.14.13.84), cyclopentanone monooxygenase (EC 1.14.13.16), phenylacetone monooxygenase, 4-hydroxyphenylacetate 3-monooxygenase (EC 1.14.13.3), 4-nitrophenol monooxygenase, 2,4,5-trichlorophenol monooxygenase, styrene monooxygenase, and variants thereof.

17. The method of claim 1 wherein the monooxygenase is:
comprised in a cell or a cell lysate, or
in isolated purified form.

18. The method of claim 1 wherein the monooxygenase is a P450 monooxygenase.

19. The method of claim 18, wherein the P450 monooxygenase is a P450 monooxygenase selected from the group consisting of SEQ ID NOs 1-151.

20. The method of claim 7, wherein the monooxygenase or the at least one member of the plurality of monooxygenases is a hydroxylating monooxygenase.

\* \* \* \* \*